US010577417B2

(12) United States Patent
Beatty et al.

(10) Patent No.: US 10,577,417 B2
(45) Date of Patent: Mar. 3, 2020

(54) TARGETING CYTOTOXIC CELLS WITH CHIMERIC RECEPTORS FOR ADOPTIVE IMMUNOTHERAPY

(71) Applicants: Novartis AG, Basel (CH); The Trustees of the University of Pennsylvania, Philadelphia, PA (US)

(72) Inventors: Gregory Beatty, Philadelphia, PA (US); Boris Engels, Arlington, MA (US); Neeraja Idamakanti, Burlington, MA (US); Carl H. June, Merion Station, PA (US); Andreas Loew, Boston, MA (US); Michael C. Milone, Cherry Hill, NJ (US); Huijuan Song, Shanghai (CN); Enxiu Wang, Upper Darby, PA (US); Qilong Wu, Shanghai (CN)

(73) Assignees: Novartis AG, Basel (CH); The Trustees of the University of Pennsylvania, Philadelphia, PA (US)

( * ) Notice: Subject to any disclaimer, the term of this patent is extended or adjusted under 35 U.S.C. 154(b) by 0 days.

(21) Appl. No.: 15/511,973

(22) PCT Filed: Sep. 17, 2015

(86) PCT No.: PCT/US2015/050715
§ 371 (c)(1),
(2) Date: Mar. 16, 2017

(87) PCT Pub. No.: WO2016/044605
PCT Pub. Date: Mar. 24, 2016

(65) Prior Publication Data
US 2017/0260268 A1    Sep. 14, 2017

(30) Foreign Application Priority Data

Sep. 17, 2014    (WO) ............... PCT/CN2014/086694
Nov. 7, 2014    (WO) ............... PCT/CN2014/090578

(51) Int. Cl.
*A61K 35/17*    (2015.01)
*C07K 14/705*    (2006.01)
(Continued)

(52) U.S. Cl.
CPC .............. *C07K 16/28* (2013.01); *A61K 35/17* (2013.01); *C07K 14/7051* (2013.01);
(Continued)

(58) Field of Classification Search
CPC .................. A61K 35/17; C07K 14/705; C07K 14/70503; C07K 14/70517; C07K 16/28;
(Continued)

(56) References Cited

U.S. PATENT DOCUMENTS 5,359,046 A    10/1994    Capon et al.
5,686,281 A    11/1997    Roberts
(Continued)

FOREIGN PATENT DOCUMENTS

CA    2863799 A1    8/2013
CN    103347897 A    10/2013
(Continued)

OTHER PUBLICATIONS

Lanitis et al, Mol. Therapy 20(3): 633-643, 2012.*
(Continued)

*Primary Examiner* — Kevin K Hill
(74) *Attorney, Agent, or Firm* — Lando & Anastasi, LLP

(57) ABSTRACT

The present invention provides compositions and methods for regulating the specificity and activity of immune effector cells for use in immunotherapy. In one embodiment, the invention provides a type of chimeric antigen receptor (CAR) wherein the CAR is termed a "NKR-CAR" which is a CAR design comprising a component of a receptor naturally found on natural killer (NK) cells. In one embodiment, the NK receptor includes but is not limited to a naturally (Continued)

occurring activating and inhibitory receptor of NK cells known as a killer cell immunoglobulin-like receptor (KIR).

33 Claims, 64 Drawing Sheets

Specification includes a Sequence Listing.

(51) Int. Cl.
    *C07K 16/28*     (2006.01)
    *C07K 16/30*     (2006.01)
    *C07K 14/725*     (2006.01)
    *C07K 14/74*     (2006.01)
    *C12N 5/0783*     (2010.01)

(52) U.S. Cl.
    CPC .... *C07K 14/7056* (2013.01); *C07K 14/70503* (2013.01); *C07K 14/70539* (2013.01); *C07K 14/70596* (2013.01); *C07K 16/30* (2013.01); *C12N 5/0636* (2013.01); *C07K 2317/56* (2013.01); *C07K 2317/565* (2013.01); *C07K 2317/622* (2013.01); *C07K 2319/03* (2013.01); *C07K 2319/74* (2013.01); *C12N 2510/00* (2013.01)

(58) Field of Classification Search
    CPC ................. C07K 16/30; C07K 2317/21; C07K 2317/56; C07K 2317/70; C07K 2319/00; C07K 2319/02; C07K 2319/03; C07K 2319/70; C07K 2319/74; C12N 5/0636; C12N 2510/00
    See application file for complete search history.

(56) References Cited

U.S. PATENT DOCUMENTS

| | | |
|---|---|---|
| 5,712,149 A | 1/1998 | Roberts |
| 5,874,240 A | 2/1999 | Ni et al. |
| 5,906,936 A | 5/1999 | Eshhar et al. |
| 6,103,521 A | 8/2000 | Capon et al. |
| 6,319,494 B1 | 11/2001 | Capon et al. |
| 6,355,779 B1 | 3/2002 | Goodwin et al. |
| 6,410,319 B1 | 6/2002 | Raubitschek et al. |
| 6,569,997 B1 | 5/2003 | Kwon |
| 7,049,136 B2 | 5/2006 | Seed et al. |
| 7,052,906 B1 | 5/2006 | Lawson et al. |
| 7,070,995 B2 | 7/2006 | Jensen |
| 7,265,209 B2 | 9/2007 | Jensen |
| 7,319,143 B2 | 1/2008 | Gross et al. |
| 7,320,787 B2 | 1/2008 | Seed et al. |
| 7,446,190 B2 | 11/2008 | Sadelain et al. |
| 7,446,191 B2 | 11/2008 | Jensen |
| 7,514,537 B2 | 4/2009 | Jensen |
| 7,638,326 B2 | 12/2009 | June et al. |
| 7,741,465 B1 | 6/2010 | Eshhar et al. |
| 7,745,140 B2 | 6/2010 | June et al. |
| 7,754,482 B2 | 7/2010 | Riley et al. |
| 7,919,279 B2* | 4/2011 | Trachtenberg ....... C12Q 1/6881 435/91.2 |
| 7,994,298 B2 | 8/2011 | Zhang et al. |
| 8,211,422 B2 | 7/2012 | Eshhar et al. |
| 8,252,914 B2 | 8/2012 | Zhang et al. |
| 8,389,282 B2 | 3/2013 | Sadelain et al. |
| 8,399,645 B2 | 3/2013 | Campana et al. |
| 8,465,743 B2 | 6/2013 | Rosenberg et al. |
| 8,637,307 B2 | 1/2014 | June et al. |
| 8,722,400 B2 | 5/2014 | Riley et al. |
| 8,906,682 B2 | 12/2014 | June et al. |
| 8,911,993 B2 | 12/2014 | June et al. |
| 8,916,381 B1 | 12/2014 | June et al. |
| 8,975,071 B1 | 3/2015 | June et al. |
| 9,101,584 B2 | 8/2015 | June et al. |
| 9,102,760 B2 | 8/2015 | June et al. |
| 9,102,761 B2 | 8/2015 | June et al. |
| 9,394,368 B2 | 7/2016 | Brogdon et al. |
| 9,573,988 B2 | 2/2017 | Brogdon et al. |
| 9,587,020 B2 | 3/2017 | Wu et al. |
| 9,745,368 B2* | 8/2017 | Milone ................. C07K 16/18 |
| 9,777,061 B2 | 10/2017 | Ebersbach et al. |
| 9,815,901 B2 | 11/2017 | Brogdon et al. |
| 2003/0060444 A1 | 3/2003 | Finney et al. |
| 2003/0077249 A1 | 4/2003 | Bebbington et al. |
| 2003/0105000 A1* | 6/2003 | Pero ....................... A61K 38/06 514/19.3 |
| 2003/0148982 A1 | 8/2003 | Brenner et al. |
| 2003/0224520 A1 | 12/2003 | June et al. |
| 2004/0038886 A1 | 2/2004 | Finney et al. |
| 2004/0043401 A1 | 3/2004 | Sadelain et al. |
| 2005/0113564 A1 | 5/2005 | Campana et al. |
| 2005/0129671 A1 | 6/2005 | Cooper et al. |
| 2007/0036773 A1 | 2/2007 | Cooper et al. |
| 2008/0131415 A1 | 6/2008 | Riddell et al. |
| 2008/0274475 A1 | 11/2008 | Braud et al. |
| 2009/0257994 A1 | 10/2009 | Jensen |
| 2011/0003385 A1 | 1/2011 | Crabtree et al. |
| 2011/0052554 A1 | 3/2011 | Zakrzewski et al. |
| 2012/0029063 A1* | 2/2012 | Zhang .................... A61K 38/10 514/44 R |
| 2012/0148552 A1 | 6/2012 | Jensen |
| 2012/0213783 A1 | 8/2012 | Rosenberg et al. |
| 2012/0321667 A1 | 12/2012 | Sentman |
| 2013/0071409 A1 | 3/2013 | Riley et al. |
| 2013/0071414 A1 | 3/2013 | Dotti et al. |
| 2013/0149337 A1 | 6/2013 | Cooper et al. |
| 2013/0155909 A1 | 6/2013 | Jackson et al. |
| 2013/0158098 A1 | 6/2013 | Liang et al. |
| 2013/0280285 A1 | 10/2013 | Schonfeld et al. |
| 2013/0287748 A1 | 10/2013 | June et al. |
| 2013/0309258 A1 | 11/2013 | June et al. |
| 2014/0050708 A1 | 2/2014 | Powell et al. |
| 2014/0099309 A1 | 4/2014 | Powell, Jr. et al. |
| 2014/0099340 A1 | 4/2014 | June et al. |
| 2014/0106449 A1 | 4/2014 | June et al. |
| 2014/0186947 A1 | 7/2014 | June et al. |
| 2014/0212446 A1 | 7/2014 | Riley et al. |
| 2014/0219975 A1 | 8/2014 | June et al. |
| 2014/0227237 A1 | 8/2014 | June et al. |
| 2014/0271635 A1 | 9/2014 | Brogdon et al. |
| 2014/0322169 A1 | 10/2014 | Harper et al. |
| 2014/0322183 A1 | 10/2014 | Milone et al. |
| 2014/0322212 A1 | 10/2014 | Brogdon et al. |
| 2014/0322275 A1 | 10/2014 | Brogdon et al. |
| 2014/0370045 A1 | 12/2014 | June et al. |
| 2015/0017141 A1 | 1/2015 | June et al. |
| 2015/0140019 A1 | 5/2015 | June et al. |
| 2015/0190428 A1 | 7/2015 | June et al. |
| 2015/0202286 A1 | 7/2015 | June et al. |
| 2015/0283178 A1 | 10/2015 | June et al. |
| 2015/0290244 A1 | 10/2015 | June et al. |
| 2015/0342994 A1 | 12/2015 | Riley et al. |
| 2016/0046724 A1 | 2/2016 | Brogdon et al. |
| 2016/0051651 A1 | 2/2016 | Brogdon et al. |
| 2016/0068601 A1 | 3/2016 | Brogdon et al. |
| 2016/0096892 A1 | 4/2016 | Brogdon et al. |
| 2016/0185861 A1 | 6/2016 | Bedoya et al. |
| 2016/0311907 A1 | 10/2016 | Brogdon et al. |
| 2016/0311917 A1 | 10/2016 | Beatty et al. |
| 2016/0340406 A1 | 11/2016 | Zhao et al. |
| 2016/0362472 A1 | 12/2016 | Bitter et al. |
| 2017/0008963 A1 | 1/2017 | Brogdon et al. |
| 2017/0081411 A1 | 3/2017 | Engels et al. |
| 2017/0137783 A1 | 5/2017 | Bedoya et al. |
| 2017/0183415 A1 | 6/2017 | Brogdon et al. |
| 2017/0209492 A1 | 7/2017 | June et al. |
| 2017/0211055 A1 | 7/2017 | Brogdon et al. |
| 2017/0226495 A1 | 8/2017 | Guimaraes |
| 2017/0239294 A1 | 8/2017 | Thomas-Tikhonenko et al. |
| 2017/0274014 A1 | 9/2017 | Brogdon et al. |
| 2017/0306416 A1 | 10/2017 | Bedoya et al. |
| 2017/0335281 A1 | 11/2017 | Loew et al. |
| 2018/0022795 A1 | 1/2018 | Milone et al. |
| 2018/0044423 A1 | 2/2018 | Ebersbach et al. |

(56) References Cited

U.S. PATENT DOCUMENTS

| | | |
|---|---|---|
| 2018/0044424 A1 | 2/2018 | June et al. |
| 2018/0118834 A1 | 5/2018 | Brogdon et al. |
| 2018/0125892 A1 | 5/2018 | Brannetti et al. |
| 2018/0133296 A1 | 5/2018 | Barrett et al. |
| 2018/0140602 A1 | 5/2018 | Angst et al. |
| 2018/0230193 A1 | 8/2018 | Loew et al. |
| 2018/0252727 A1 | 9/2018 | Garfall et al. |
| 2018/0258149 A1 | 9/2018 | Motz et al. |
| 2018/0298068 A1 | 10/2018 | Albelda |
| 2018/0312595 A1 | 11/2018 | Brogdon et al. |
| 2019/0000880 A1 | 1/2019 | Motz et al. |
| 2019/0000944 A1 | 1/2019 | Brogdon et al. |
| 2019/0135940 A1 | 5/2019 | Brogdon et al. |
| 2019/0151365 A1 | 5/2019 | Anak et al. |
| 2019/0153061 A1 | 5/2019 | Brogdon et al. |
| 2019/0161542 A1 | 5/2019 | Gill et al. |
| 2019/0263914 A1 | 8/2019 | Brogdon et al. |
| 2019/0269727 A1 | 9/2019 | Fachin et al. |

FOREIGN PATENT DOCUMENTS

| | | |
|---|---|---|
| EP | 0574512 A1 | 12/1993 |
| EP | 0871495 A1 | 10/1998 |
| EP | 1226244 A2 | 7/2002 |
| WO | 1992015322 A1 | 9/1992 |
| WO | 09418317 A1 | 8/1994 |
| WO | 199530014 A1 | 11/1995 |
| WO | 9623814 A1 | 8/1996 |
| WO | 9624671 A1 | 8/1996 |
| WO | 09640140 A1 | 12/1996 |
| WO | 1997015669 A1 | 5/1997 |
| WO | 9723613 A2 | 7/1997 |
| WO | 9818809 A1 | 5/1998 |
| WO | 9900494 A2 | 1/1999 |
| WO | 9906557 A2 | 2/1999 |
| WO | 9957268 A1 | 11/1999 |
| WO | 0014257 A1 | 3/2000 |
| WO | 2002033101 A1 | 4/2002 |
| WO | 02077029 A2 | 10/2002 |
| WO | 02088334 A1 | 11/2002 |
| WO | 2003057171 A2 | 7/2003 |
| WO | 2005019429 A2 | 3/2005 |
| WO | 2005044996 A2 | 5/2005 |
| WO | 2005/118788 A2 | 12/2005 |
| WO | 2006060878 A1 | 6/2006 |
| WO | 2007/002905 A1 | 1/2007 |
| WO | 2008045437 A2 | 4/2008 |
| WO | 2010085660 A2 | 7/2010 |
| WO | 2011059836 A2 | 5/2011 |
| WO | 2011097477 A1 | 8/2011 |
| WO | 2011119773 A1 | 9/2011 |
| WO | 2012058460 A2 | 5/2012 |
| WO | 2012079000 A1 | 6/2012 |
| WO | 2012082841 A2 | 6/2012 |
| WO | 2012/099973 A2 | 7/2012 |
| WO | 2012127464 A2 | 9/2012 |
| WO | 2012129514 A1 | 9/2012 |
| WO | 2012135854 A2 | 10/2012 |
| WO | 2012138858 A1 | 10/2012 |
| WO | 2013019615 A2 | 2/2013 |
| WO | 2013033626 A2 | 3/2013 |
| WO | 2013040371 A2 | 3/2013 |
| WO | 2013040557 A2 | 3/2013 |
| WO | 2013051718 A1 | 4/2013 |
| WO | 2013059593 A1 | 4/2013 |
| WO | 2013063419 A2 | 5/2013 |
| WO | 2013074916 A1 | 5/2013 |
| WO | 2013/126712 A1 | 8/2013 |
| WO | 2013126729 A1 | 8/2013 |
| WO | 2013126733 A1 | 8/2013 |
| WO | 2013142034 A1 | 9/2013 |
| WO | 2013153270 A1 | 10/2013 |
| WO | 2013166051 A1 | 11/2013 |
| WO | 2014/011984 A1 | 1/2014 |
| WO | 2014/011987 A1 | 1/2014 |
| WO | 2014/011993 A2 | 1/2014 |
| WO | 2014/012001 A2 | 1/2014 |
| WO | 2014011988 A2 | 1/2014 |
| WO | 2014011996 A1 | 1/2014 |
| WO | 2014031687 A1 | 2/2014 |
| WO | 2014039513 A2 | 3/2014 |
| WO | 2014/055442 A2 | 4/2014 |
| WO | 2014055657 A1 | 4/2014 |
| WO | 2014127261 A1 | 8/2014 |
| WO | 2014130635 A1 | 8/2014 |
| WO | 2014130657 A1 | 8/2014 |
| WO | 2014145252 A2 | 9/2014 |
| WO | 2014153270 A1 | 9/2014 |
| WO | PCT/CN2014/090578 | * 11/2014 |
| WO | 2015090229 A1 | 6/2015 |
| WO | 2015090230 A1 | 6/2015 |
| WO | WO 15/090229 | * 6/2015 |
| WO | 2015112626 A1 | 7/2015 |
| WO | 2015/142661 A1 | 9/2015 |
| WO | 2015142675 A2 | 9/2015 |
| WO | WO 15/142661 | * 9/2015 |
| WO | 2015157252 A1 | 10/2015 |
| WO | WO 15/166056 | * 11/2015 |
| WO | 2016014501 A1 | 1/2016 |
| WO | 2016014530 A1 | 1/2016 |
| WO | 2016014535 A1 | 1/2016 |
| WO | 2016014553 A1 | 1/2016 |
| WO | 2016014565 A2 | 1/2016 |
| WO | 2016014576 A1 | 1/2016 |
| WO | 2016019300 A1 | 2/2016 |
| WO | 2016025880 A1 | 2/2016 |
| WO | 2016028896 A1 | 2/2016 |
| WO | 2016044605 A1 | 3/2016 |

OTHER PUBLICATIONS

Rudikoff et al, PNAS 79: 1979-1983, 1982.*
Coleman et al, Research in Immunology 145(1): 33-36, 1994.*
Burgess et al, J Cell Biol. 111:2129-2138, 1990.*
Ibragimova et al, Biophysical Journal 77(10): 2191-2198, 1999.*
Morello et al. "Mesothelin-Targeted CARs: Driving T Cells to Solid Tumors" Cancer Discovery (2016) doi:10.1158/2159-8290.CD-15-0583; pp. OF1-OF15.
Lo et al., "Anti-GD3 chimeric sFv-CD28/T-cell receptor zeta designer T cells for treatment of metastatic melanoma and other neuroectodermal tumors." Clin Cancer Res (2010) vol. 16 No. 10 pp. 2769-2780.
Loskog et al. "Addition of the CD28 signaling domain to chimeric T-cell receptors enhances chimeric T-cell resistance to T regulatory cells." Leukemia (2006) vol. 20 No. 10 pp. 1819-1828.
Ma et al., "Recognition of mesothelin by the therapeutic antibody MORAb-009: structural and mechanistic insights." J Biol Chem (2012) vol. 287 No. 40 pp. 33123-33131.
MacAllan et al., "Measurement and modeling of human T cell kinetics" European Journal of Immunology (2003) vol. 33 pp. 2316-2326.
Maher et al., "Human T lymphocyte cytotoxicity and proliferation directed by a single chimeric TCRzeta/CD28 receptor," Nat. Biotechnol. 20: 70-75 (2002).
Maus et al., "T cells expressing chimeric antigen receptors can cause anaphylaxis in humans" Cancel Immunol Res, 1:26-31 (2013).
McGuinness et al., "Anti-tumor activity of human T cells expressing the CC49-zeta chimeric immune receptor," Hum. Gene Ther. 10: 165-173 (1999).
Milone et al, "Chimeric Receptors Containing CD137 Signal Transduction Domains Mediate Enhanced Survival of T Cells and Increased Antileukemic Efficacy In Vivo" Molecular Therapy (2009) vol. 17 No. 8 pp. 1453-1464.
Molina, "A Decade of Rituximab: Improving Survival Outcomes in Non-Hodgkin's Lymphoma" Annu. Rev. Med. (2008) vol. 59 pp. 237-250.
Moretta et al., "Major histocompatibility complex class I-specific receptors on human natural killer and T lymphocytes" Immunological Reviews (1997) vol. 155 pp. 105-117.
Morgan et al., "Case Report of a Serious Adverse Event Following the Administration of T Cells Transduced With a Chimeric Anitgen Receptor Recognizing ErbB2," Mol. Ther. 18(4): 843-851 (2010).

(56) References Cited

OTHER PUBLICATIONS

Moritz and Groner, "A spacer region between the single chain antibody- and the CD3 zeta-chain domain of chimeric T cell receptor components is required for efficient ligand binding and signaling activity," Gene Therapy 2(8): 539-546 (1995).
Moritz et al., "Cytotoxic T lymphocytes with a grafted recognition specificity for ERBB2-expressing tumor cells" Proc. Natl. Acad. Sci (1994) vol. 91 pp. 4318-4322.
Naldini et al., "In Vivo Gene Delivery and Stable Transduction of Nondividing Cells by a Lentiviral Vector" Science (1996) vol. 272 pp. 263-267.
NCBI accession HM_852952 accessed Sep. 29, 2015 from http://www.ncbi.nlm.nih.gov/nuccore/hm852952.
Nicholson et al., "Construction and Characterisation of a Function CD19 Specific Single Chain Fv Fragment for Immunotherapy of B Lineage Leukaemia and Lymphoma," Molecular Immunology 34(I6-I7): 1157-1165 (1997).
Ohlen et al., "Prevention of Allogeneic Bone Marrow Graft Rejection by H-2 Transgene in Donor Mice" Science (1989) vol. 246 pp. 666-668.
Okazaki et al. "PD-1 immunoreceptor inhibits B cell receptor-mediated signaling by recruiting src homology 2-domain-containing tyrosine phosphatase 2 to phosphotyrosine" PNAS (2001) vol. 98, No. 24, pp. 13866-13871.
Olcese et al., "Human killer cell activatory receptors for MHC class I molecules are included in a multimeric complex expressed by natural kill cells." J Immunol (1997) vol. 158 pp. 5083-5086.
Park and Brentjens "Adoptive Immunotherapy for B-cell Malignancies with Autologous Chimeric Antigen Receptor Modified Tumor Targeted T Cells" Discovery Medicine (2010) vol. 9 No. 47 pp. 277-288.
Park et al. "Adoptive Transfer of Chimeric Antigen Receptor Re-directed Cytolytic T Lymphocyte Clones in Patients with Neuroblastoma", Molecular Therapy (2007) vol. 15 No. 4 pp. 825-833.
Pasquale, "Eph receptors and ephrins in cancer: bidirectional signalling and beyond." Nat Rev Cancer (2010) vol. 10 No. 3 pp. 165-180.
Patel et al., "Impact of chimeric immune receptor extracellular protein domains on T cell function" Gene Therapy (1999) vol. 6 pp. 412-419.
Porter et al. "Chimeric Antigen Receptor-Modified T Cells in Chronic Lymphoid Leukemia", The New England Journal of Medicine (2011) vol. 365 No. 8 pp. 725-733.
Porter et al., "A phase 1 trial of donor lumphocyte infusions expanded and activated ex vivo via CD3/CD28 costimulation" Blood (2006) vol. 107 No. 4 pp. 1325-1331.
Porter et al. "Chimeric Antigen Receptor Therapy for B-cell Malignancies" Journal of Cancer (2011) vol. 2 pp. 331-332.
Pule et al., "Virus-specific T cells engineered to coexpress tumor-specific receptors: persistence and antitumor activity in individuals with neuroblastoma" Nat. Med. (2008) vol. 14 No. 11 pp. 1264-1270.
Rapoport et al., "Restoration of immunity in lymphopenic individuals with cancer by vaccination and adoptive T-cell transfer" Nature Medicine (2005) vol. 11 No. 11 pp. 1230-1237.
Ravetch & Bolland, "IcG Fc Receptors" Annu. Rev. Immunol. (2001) vol. 19 pp. 275-290.
Remtoula et al., "Selective expression of inhibitory or activating killer cell Ig-like receptors in circulating CD4 T lymphocytes" Journal of Immunology (2008) vol. 180 No. 5 pp. 2767-2771.
Roederer, "T-cell dynamics of immunodeficiency" Nature Medicine (1995) vol. 1 No. 7 pp. 621-622.
Romeo et al., "Cellular immunity to HIV activated by CD4 fused to T cell or Fc receptor polypeptides," Cell 64:1037-1046 (1991).
Rosen et al., "A Structural basis for the association of DAP12 with mouse, but not human, NKG2D." J Immunol (2004) vol. 173 No. 4 pp. 2470-2478.
Sabbagh et al., "TNF family ligands define niches for T cell memory" Trends in Immunology (2007) vol. 28 No. 8 pp. 333-339.
Sadelain et al. "The promise and potential pitfalls of chimeric antigen receptors." Current Opinion Immunology (2009) vol. 21 No. 2 pp. 215-223.
Sadelain et al., "Targeting Tumours with Genetically Enhanced T Lymphocytes," Nature Reviews: Cancer 3: 35-45 (2003).
Sadelain et al., "The Basic Principles of Chimeric Antigen Receptor Design" Cacner Discovery (2013) vol. 3 No. 4 pp. 388-398.
Savoldo et al., "CD28 costimulation improves expansion and persistence of chimeric antigen receptor-modified T cells in lymphoma patients" The Journal of Clinical Investigation (2011) vol. 121 No. 5 pp. 1822-1826.
Sebestyen et al., "Human TCR That Incorporate CD3 Induce Highly Preferred Pairing between TCR and Chains following Gene Transfer" Journal of Immunology (2008) vol. 180 pp. 7736-7746.
Shirasu et al., "Functional Design of Chimeric T-Cell Antigen Receptors for Adoptive Immunotherapy of Cancer: Architecture and Outcomes," AntiCancer Res. 32: 2377-2384 (2012).
Shook et al., "Natural killer cell engineering for cellular therapy of cancer" Tissue Antigens (2011) vol. 78 No. 6 pp. 409-415.
Singh et al., "Claudin Family of Proteins and Cancer: An Overview" Journal of Oncology (2010) Article ID 541957.
Snyder et al., "Stimulatory killer Ig-like receptors modulate T cell activation through DAP12-dependent and DAP12-independent mechanisms." J Immunol (2004) vol. 173 No. 6 pp. 3725-3731.
Sorror et al., "Outcomes after allogeneic hematopoietic cell transplantation with nonmyeloablative or myeloablative conditioning regimens for treatment of lymphoma and chronic lymphocytic leukemia" Blood (2008) vol. 111 No. 1 pp. 446-452.
Stewart et al., "Strategies of Natural Killer Cell Recognition and Signaling" CTMI (2006) vol. 298 pp. 1-21.
Takase et al., "A new 12-kilodalton dimer associated with pre-TCR complex and clonotype-independent CD3 complex on immature thymocytes." J Immunol (1997) vol. 159 pp. 741-747.
Tal et al., "An NCR1-based chimeric receptor endows T-cells with multiple anti-tumor specificities" Oncotarget (2014) pp. 1-10.
Tchou et al "Mesothelin, a novel immunotherapy target for triple negative breast cancer" Breast Cancer Research and Treatment (2012) vol. 133, Iss 2, pp. 799-804.
Teng et al., "T cells gene-engineered with DAP12 mediate effector function in an NKG2D-dependent and major histocompatibility complex-independent manner." J Biol Chem (2005) vol. 280 No. 46 pp. 38235-38241.
Thielens et al. "NK cell MHC class I specific receptors (KIR): from biology to clinical intervention" Current Opinion in Immunology (2012) vol. 24, pp. 239-245.
Hassan et al., "Antitumor activity of SS(dsFv)PE38 and SS1(dsFv)PE38, recombinant antimesothelin immunotoxins against human gynecologic cancers grown in organotypic culture in vitro" Clinical Cancer Research (2002) vol. 8 No. 11 pp. 3520-3526.
Hekele et al., "Growth Retardation of Tumors by Adoptive Transfer of Cytotoxic T Lymphocytes Reprogrammed by CD44V6-Specific SCFV:—Chimera" Int J. Cancer (1996) vol. 68 pp. 232-238.
Ho et al., "Adoptive immunotherapy: Engineering T cell responses as biological weapons for tumor mass destruction" Cancer Cell (2003) vol. 3 pp. 431-437.
Hollyman et al. "Manufacturing validation of biologically functional T cells targeted to CD19 antigen for autologous adoptive cell therapy" J Immunother (2009) vol. 32 No. 2 pp. 169-180.
Hornback et al., "The Recombinant T Cell Receptor Strategy: Insights into Structure and Function of Recombinant Immunoreceptors on the Way Towards an Optimal Receptor Design for Cellular Immunotherapy," Current Gene Therapy 2: 211-226 (2002).
Imai et al., "Chimeric receptors with 4-1BB signaling capacity provoke potent cytotoxicity against acute lymphoblastic leukemia," Leukemia 18: 676-684 (2004).
Imai et al., "Genetic modification of primary natural killer cells overcomes inhibitory signals and induces specific killing of leukemic cells" Blood (2005) vol. 106 No. 1 pp. 376-383.
International Preliminary Report on Patentability and Written Opinion of the International Searching Authority for PCT/US2014/029983 dated Sep. 15, 2015.
International Preliminary Report on Patentability for International Application No. PCT/CN2014/094383 dated Jun. 21, 2016.

(56) References Cited

OTHER PUBLICATIONS

International Preliminary Report on Patentability for International Application No. PCT/US2015/020533 dated Sep. 20, 2016.
International Preliminary Report on Patentability for International Application No. PCT/US2015/050715 dated Mar. 21, 2017.
International Search Report and Written Opinion for International Application No. PCT/CN2014/082615 dated Oct. 27, 2014.
International Search Report and Written Opinion for International Application No. PCT/CN2014/086694 dated Feb. 6, 2015.
International Search Report and Written Opinion for International Application No. PCT/CN2014/094383, dated Mar. 20, 2015.
International Search Report and Written Opinion for International application No. PCT/CN2014/094393, dated Mar. 30, 2015.
International Search Report and Written Opinion for International Application No. PCT/US2015/050715 dated Feb. 4, 2016.
International Search Report and Written Opinion for International Application No. PCT/US2015/20533 dated Jun. 26, 2015.
International Search Report and Written Opinion of the International Searching Authority for PCT/CN2014/090578 dated Jun. 17, 2015.
International Search Report for International Application No. PCT/CN2013/089979 dated Sep. 26, 2014.
International Search Report for PCT/US2014/029983 dated Oct. 28, 2014.
International Search Report from PCT/US2011/064191 dated Jan. 5, 2012.
Irving et al., "The cytoplasmic domain of the T cell receptor zeta chain is sufficient to couple to receptor-associated signal transduction pathways," Cell 64: 891-901 (1991).
James et al. "Biophysical mechanism of T-cell receptor triggering in a reconstituted system", Nature (2012) vol. 487 pp. 64-69.
Jena, Bipulendu et al. "Redirecting T-cell specificity by introducing a tumor-specific chimeric antigen receptor, Blood, May 3, 2010", vol. 116, No. 7, pp. 1035-1044.
Jensen et al., "Anti-Transgene Rejection Responses Contribute to Attenuated Persistence of Adoptively Transferred CD20/CD19-Specific Chimeric Antigen Receptor Re-directed T Cells in Humans" Biol Blood Marrow Transplant (2010) vol. 16 No. 9 pp. 1245-1256.
Johnson et al., "Gene therapy with human and mouse T-cell receptors mediates cancer regression and targets normal tissues expressing cognate antigen" Blood (2009) vol. 114 No. 3 pp. 535-545.
June et al., "Engineering lymphocyte subsets: tools, trials and tribulations" Nat Rev Immunol (2009) vol. 9 No. 10 pp. 704-716.
Karre et al., "Selective rejection of H-2-deficient lymphoma variants suggests alternative immune defence strategy." Nature (1986) vol. 319 No. 6055 pp. 675-678.
Katz et al. "Recognition of HLA-Cw4 but Not HLA-Cw6 by the NK Cell Receptor Killer Cell Ig-Like Receptor Two-Domain Short Tail No. 4" The Journal of Immunology (2001) vol. 166, pp. 7260-7267.
Kershaw et al., "A Phase I Study on Adoptive Immunotherapy Using Gene-Modified T Cells for Ovarian Cancer," Clin. Cancer Res. 12(20 Pt 1): 6106-6115 (2006).
Kim et al., "Human 4-1BB regulates CD28 co-stimulation to promote Th1 cell responses" Eur. J. Immunol. (1998) vol. 28 pp. 881-890.
Kloss et al., "Combinatorial antigen recognition with balanced signaling promotes selective tumor eradication by engineered T cells" Nature Biotechnology (2013) vol. 31 No. 1 pp. 71-75.
Kochenderfer et al, "A Phase I Clinical Trial of Treatment of B-Cell Malignancies with Autologous Anti-Cd19-CAR-Transduced T Cells" Blood (2010) vol. 116 No. 21 pp. 1179-1180 & 52nd Annual Meeting of the American-Society-of-Hematology (ASH); Orlando, FL, USA; Dec. 4-7, 2010 abstract.
Kochenderfer et al. "Construction and Pre-clinical Evaluation of an Anti-CD19 Chimeric Antigen Receptor", J Immunother (2009) vol. 32, No. 7, pp. 389-702.
Kochenderfer et al., "Eradication of B-lineage cells and regression of lymphoma in a patient treated with autologous T cells genetically-engineered to recognize CD19," Blood 116: 4099-4102 (2010).
Kraus et al., "Antigen-dependent CD28 Signaling Selectively Enhances Survival and Proliferation in Genetically Modified Activated Human Primary T Lymphocytes" J. Exp. Med. (1998) vol. 188 Np 4 pp. 619-626.
Kruse et al., "Natural cytotoxicity receptors and their ligands" Immunology and Cell Biology (2013) vol. 92 No. 3 pp. 221-229.
Kwon et al., "cDNA sequences of two inducible T-cell genes". Proc. Natl. Acad. Sci. U.S.A. 86(6): 1963-1967 (1989).
Lamanna et al., "Pentostatin, Cyclophosphamide, and Rutuximab Is an Active, Well-Tolerated Regimen for Patients With Previously Treated Chronic Lymphocytic Leukemia" Journal of Clinical Oncology (2008) vol. 24 No. 10 pp. 1575-1581.
Lamers et al., "Treatment of Metastatic Renal Cell Carcinoma With Autologous T-Lymphocytes Genetically Retargeted Against Carbonic Anhydrase IX: First Clinical Experience," J. Clin. Oncol. 24(13): e20-e22 (2006).
Lanier et al., "Immunoreceptor DAP12 bearing a tyrosine-based activation motif is involved in activating NK cells" Nature (1998) vol. 391 pp. 703-707.
Lanier, "Up on the tightrope: natural killer cell activation and inhibition." Nat Immunol (2008) vol. 9 No. 5 pp. 495-502.
Lanitis et al., "Redirected Antitumor Activity of Primary Human Lymphocytes Transduced With a Fully Human Anti-mesothelin Chimeric Receptor" Molecular Therapy, 20(3):633-643 (2012).
Laport et al., "Adoptive transfer of costimulated T cells induces lymphocytosis in patients with relapsed/refractory non-Hodgkin lymphoma following CD34+-selected hematopoietic cell transplantation" Blood (2003) vol. 102 No. 6 pp. 2004-2013.
Lee et al., "In vivo Inhibition of Human CD19-Targeted Effector T Cells by Natural T Regulatory Cells in a Xenotransplant Murine Model of B Cell Malignancy" Cancer Research (2011) vol. 71 No. 8 pp. 2871-2881.
Lee et al., "The Future is Now: Chimeric Antigen Receptors as New Targeted Therapies for Childhood Cancer," Clin. Cancer Res. 18: 2780-2790 (2012).
Letourneur et al., "T-cell and basophil activation through the cytoplasmic tail of T-cell-receptor zeta family proteins," Proc. Natl. Acad. Sci. U.S.A 88: 8905-8909 (1991).
Levine et al., "Gene transfer in humans using a conditionally replicating lentiviral vector" PNAS (2006) vol. 103 No. 46 pp. 17372-17377.
Arnon et al., "Inhibition of the NKp30 activating receptor by pp65 of human cytomegalovirus" Nature Immunology (2005) vol. 6 No. 5 pp. 515-523.
Baba et al. "N-Linked Carboydrate on Human Leukocyte Antigen-C and Recognition by Natural Killer Cell Inhibitory Receptors" Humman Immunology (2000) vol. 61, pp. 1202-1218.
Baeksgaard & Sorensen, "Acute tumor lysis syndrome in solid tumors—a case report and review of the literature" Cancer Chemotherapy Pharmacology (2003) vol. 51 pp. 187-192.
Barrett et al., "Chimeric Antigen Receptor Therapy for Cancer" Annu Rev Med (2014) vol. 65 pp. 333-347.
Barrow et al., "You say ITAM and I say ITIM, let's call the whole thing off: the ambiguity of immunoreceptor signalling" European Journal of Immunology (2006) vol. 36 No. 7 pp. 1646-1653.
Biassoni et al., "Chapter 4 Natural Killer Cell Receptors" Multichain Immune Recognition Receptor Signaling (2008) vol. 640 pp. 35-52.
Bondanza et al. "Suicide gene therapy of graft-versus-host disease induced by central memory human T lymphocytes" Blood (2006) vol. 107 No. 5 pp. 1828-1836.
Borszcz et al. "KIR enrichment at the effector-target cell interface is more sensitive than signaling to the strength of ligand binding" European Journal of Immunology (2003) vol. 33, pp. 1084-1093.
Bottino et al., "NK Cell Activating Receptors and Tumor Recognition in Humans" CTMI (2006) No. 298 pp. 175-182.
Brentjens et al. "Genetically Targeted T Cells Eradicate Systemic Acute Lymphoblastic Leukemia Xenografts", Clinical Cancer Research(2007) vol. 13, No. 18, pp. 5426-5435.
Brentjens et al. "Treatment of Chronic Lymphocytic Leukemia With Genetically Targeted Autologous T Cells: Case Report of an Unforeseen Adverse Event in a Phase I Clinical Trial" The American Society of Gene Therapy (2010) vol. 18 No. 4 pp. 666-668.

(56) References Cited

OTHER PUBLICATIONS

Brentjens et al., "A Phase I Trial for the Treatment of chemo—Refractory Chronic Lymphocytic Leukemia with CD19-Targeted Autologous T Cells" Molecular Therapy (2008) vol. 16 Suppl 1 p. S15.
Brentjens et al., "Eradication of systemic B-cell tumors by genetically targeted human T lymphocytes co-stimulated by CD80 and interleukin-15" Nature Medicine (2003) vol. 9 No. 3 pp. 279-286.
Brentjens et al., "Safety and persistence of adoptively transferred autologous CD19-targeted T cells in patients with relapsed or chemotherapy refractory B-cell leukemias" Blood (2011) vol. 118 No. 18 pp. 4817-4828.
Brocker and Karjalainen, "Signals through T Cell Receptor-Chain alone Are Insufficient to Prime Resting T Lymphocytes" J. Exp. Med. (1995) vol. 181 pp. 1653-1659.
Brooks et al. "Growth Hormone receptor; mechanism of action" The International Journal of Biochemistry & Cell Biology (2008) vol. 40, pp. 1984-1989.
Bryceson & Long, "Line of attack: NK cell specificity and integration of signals" Current Opinion Immunology (2008) vol. 20 No. 3 pp. 344-352.
Call & Wucherpfennig, "The T Cell Receptor: Critical Role of the Membrane Environment in Receptor Assembly and Function" Annu. Rev. Immunol. (2005) vol. 23 pp. 101-125.
Campbell et al., "Natural killer cell biology: an update and future directions" Journal of Allergy and Clinical Immunology (2013) vol. 132 No. 3 pp. 536-544.
Carpenito et al. "Control of large, established tumor xenografts with genetically retargeted human T cells containing CD28 and CD137 domains", Proc Natl Acad Sci USA (2009) vol. 106 pp. 3360-3365.
Choudhuri et al., "T-cell receptor triggering is critically dependent on the dimensions of its peptide-MHC ligand" Nature (2005) vol. 436 pp. 578-582.
Christensen et al. "Recruitment of SHP-1 Protein Tyrosine Phosphatase and Signalling by a Chimeric T-Cell Receptor-Killer Inhibitory Receptor" Scand. J. Immunol. (2000) vol. 51, pp. 557-564.
Daeron et al., "The Same Tyrosine-Based Inhibition Motif, in the Intra-cytoplasmic Domain of FcyRIIB, Regulates Negatively BCR-, TCR-, and FcR-Dependent Cell Activation" Immunity (1995) vol. 3 pp. 635-646.
Davila et al. "B Cell Aplasia in a Patient with Relapsed B Cell Acute Lymphoblastic Leukemia Following Re-Induction and Consolidation with Autologous T Cells Genetically Targeted to the CD19 Antigen" 53rd ASH Annual Meeting and Exposition (2010) Oral and Poster Abstract.
Dohner et al., "p53 Gene Deletion Predicts for Poor Survival and Non-Response to Therapy With Purine Analogs in Chronic B-Cell Leukemias" Blood (1995) vol. 85 No. 6 pp. 1580-1589.
Dropulic and June, "Gene-Based Immunotherapy for Human Immunodeficiency Virus Infection and Acquired Immunodeficiency Syndrome" Human Gene Therapy (2006) vol. 17 pp. 577-588.
Dull et al, "A Third-Generation Lentivirus Vector with a Conditional Packaging System" Journal of Virology (1998) vol. 72 No. 11 pp. 8463-8471.
Eshhar et al., "Specific activation and targeting of cytotoxic lymphocytes through chimeric single chains consisting of antibody-binding domains and the gamma or zeta subunits of the immunoglobulin and T-cell receptors," PNAS USA 90: 720-724 (1993).
Falk et al., "Non-MHC-Restricted CD4+ T Lymphocytes are Regulated by HLA-Cw 7-mediated Inhibition" Human Immunology (2000) vol. 61 pp. 1219-1232.
Fegan et al. "Chemically Controlled Protein Assembly: Techniques and Applications", Chem Rev (2010) vol. 110, pp. 3315-3336.
Feng et al, "The assembly of diverse immune receptors is focused on polar membrane-embedded interaction site." PLoS Biol. (2006) vol. 4 No. 5 e142.
Finney et al., "Activation of resting human primary T cells with chimeric receptors: costimulation from CD28, inducible costimulator, CD134, and CD137 (4-1BB) in series with signals from the TCR zeta chain," J. Immunol. 172: 104-113 (2004).

Finney et al., "Chimeric receptors providing both primary and costimulatory signaling in T cells from a single gene product," J. Immunol. 161: 2791-2797 (1998).
Frey, N. "Genetically Engineered Lymphocyte Therapy in Treating Patients With B-Cell Leukemia or Lymphoma That is Resistant or Refractory to Chemotherapy" (2015) Clinical Trial NCT01029366.
Friedmann-Morvinski et al., "Redirected primary T cells harboring a chimeric receptor require costimulation for their antigen-specific activation," Blood 105: 3087-3093 (2005).
Garfall, et al. "Imunotherapy with chimeric antigen receptors for multiple myeloma." Discovery Medicine. 17 (91) (pp. 37-46), Jan. 2014.
Geiger & Jyothi, "Development and Application of Receptor-Modified T Lymphocytes for Adoptive Immunotherapy" Transfusion Medicine Reviews (2001) vol. 15 No. 1 pp. 21-34.
Geiger et al., "Integrated src kinase and constimulatory activity enhances signal transduction through single-chain chimeric receptors in T lymphocytes," Blood 98(8): 2364-2371 (2001).
GenBank Accession No. NP_000725.1 accessed on Jan. 7, 2016 from http://www.ncbi.nlm.nih.gov/protein/NP_000725.
GenBank Accession No. NP_932170.1 accessed Jan. 7, 2016 from http://www.ncbi.nlm.nih.gov/protein/NP_932170.
Gilham et al., "Primary Polyclonal Human T Lymphocytes Targeted to Carcino-Embryonic Antigens and Neural Cell Adhesion Molecule Tumor Antigens by CD3-Based Chimeric Immune Receptors" Journal of Immunotherapy (2002) vol. 25 No. 2 pp. 139-151.
Gong et al. "Cancer Patient T Cells Genetically Targeted to Prostate-Specific Membrane Antigen Specifically Lyse Prostate Cancer Cells and Release Cytokines in Response to Prostate-Specific Membrane Antigen" Neoplasia (1999) vol. 1 No. 2 pp. 123-127.
Gribben et al., "Stem cell transplantation for indolent lymphoma and chronic lymphocytic leukemia" Biol Blood Marrow Transplant (2011) vol. 17 (1 Suppl): S63-S70.
Griffin, "Development and applications of surface-linked single chain antibodies against T-cell antigens" Journal of Immunological Methods (2001) vol. 248 pp. 77-90.
Gross et al., "Endowing T cells with antibody specificity using chimeric T cell receptors," The FASEB Journal 6: 3370-3378 (1992).
Grupp et al. "Chimeric Antigen Receptor-Modified T Cells for Acute Lymphoid Leukemia", New England Journal of Medicine (2013) vol. 368 No. 16 pp. 1509-1518.
Hallek et al., "Guidelines for the diagnosis and treatment of chronic lymphocytic leukemia: a report from the International Workshop on Chronic Lymphocytic Leukemia updating the National Cancer Institute Working Group 1996 guidelines" Blood (2008) vol. 111 No. 12 pp. 5446-5456.
Thielens et al., "NK cell MHC class I specific receptors (KIR): from biology to clinical intervention" Curent Opinion in Immunology (2012) vol. 24 pp. 239-245.
Thomas, "Of ITAMs and ITIMs: turning on and off the B cell antigen receptor." J Exp Med (1995) vol. 181 No. 6 pp. 1953-1956.
Till et al., "Adoptive immunotherapy for indolent non-Hodgkin lymphoma and mantle cell lymphoma using genetically modified autologous CD20-specific T cells" Blood (2008) vol. 112 No. 6 pp. 2261-2271.
Uckun et al., "Detailed studies on expression and function of CD19 surface determinant by using B43 monoclonal antibody and the clinical potential of anti-CD19 immunotoxins" Blood (1988) vol. 71 pp. 13-29.
Varela-Rohena et al., "Control of HIV-1 immune escape by CD8 T cells expressing enhanced T-cell receptor." Nat Med (2008) vol. 14 No. 12 pp. 1390-1395.
Vinay & Kwon, "Role of 4-1BB in immune responses" Immunology (1998) vol. 10 pp. 481-489.
Wang et al. "A Chimeric Antigen Receptor (CARs) Based Upon a Killer Immunoglobulin-Like Receptor (KIR) Triggers Robust Cytotoxic Activity in Solid Tumors" Molecular Therapy (2014) vol. 22, No. 1, Suppl. 1, pp. S57.
Willemsen et al., "Genetic Engineering of T Cell Specificity for Immunotherapy of Cancer" Human Immunology (2003) vol. 64 pp. 56-68.

(56) References Cited

OTHER PUBLICATIONS

Zhang et al. "Generation of Antitumor Responses by Genetic Modification of Primary Human T Cells with a Chimeric NKG2D Receptor" Cancer Research (2006) vol. 66, No. 11, pp. 5927-5933.
Zhang et al., "An NKp30-Based Chimeric Antigen Receptor Promotes T Cell Effector Functions and Antitumor Efficacy in Vivo" The Journal of Immunology (2012) vol. 189 No. 5 pp. 2290-2299.
Zhao et al., "A Herceptin-Based Chimeric Antigen Receptor with Modified Signaling Domains Leads to Enhanced Survival of Transduced T Lymphocytes and Antitumor Activity" The Journal of Immunology (2009) vol. 183 pp. 5563-5574.
Zufferey et al., "Multiply attenuated lentiviral vector achieves efficient gene delivery in vivo" Nature Biotechnology (1997) vol. 15 pp. 871-876.
Brentjens et al., "CD19-Targeted T Cells Rapidly Induce Molecular Remissions in Adults with Chemotherapy-Refractory Acute Lymphoblastic Leukemia," Sci. Transl. Med. 5:177ra138 (2013) pp. 1-9.
Brocker, "Chimeric Fv-zeta or Fv-e receptors are not sufficient to induce activation or cytokine production in peripheral T cells" Blood (2000) vol. 96 No. 5, pp. 1999-2001.
Campbell et al., "NKp44 Triggers NK Cell Activation through DAP12 Association That Is Not Influenced by a Putative Cytoplasmic Inhibitory Sequence," The Journal of Immunology (2004) vol. 172, pp. 899-906.
Enxiu et al., "A Chimeric Antigen Receptor (CARs) Based Upon a Killer Immunoglobulin-Like Receptor (KIR) Triggers Robust Cytotoxic Activity in Solid Tumors" Molecular Therapy (2014) vol. 22 No. Supplm. 1 p. S57.
Kalos et al. "T Cells with Chimeric Antigen Receptors Have Potent Antitumor Effects and Can Establish Memory in Patients with Advanced Leukemia", Science Translation Medicine (2011) vol. 3 No. 95 95ra73. pp. 1-11.
Klingemann, "Are natural killer cells superior CAR drivers?" Oncoimmunology (2014) vol. 3 No. 1 pp. e281471-e281474.
Vivier et al, "Signaling Function of Reconstituted CD16:Zeta:Gamma Receptor Complex Isoforms" International Immunology (1992) vol. 4 No. 11 pp. 1313-1323.
Zhang et al. "An NKp30-Based Chimeric Antigen Receptor Promotes T Cell Effector Functions and Antitumor Efficacy in vivo" Journal of Immunology (2012) vol. 189 No. 5, pp. 1-10.

* cited by examiner

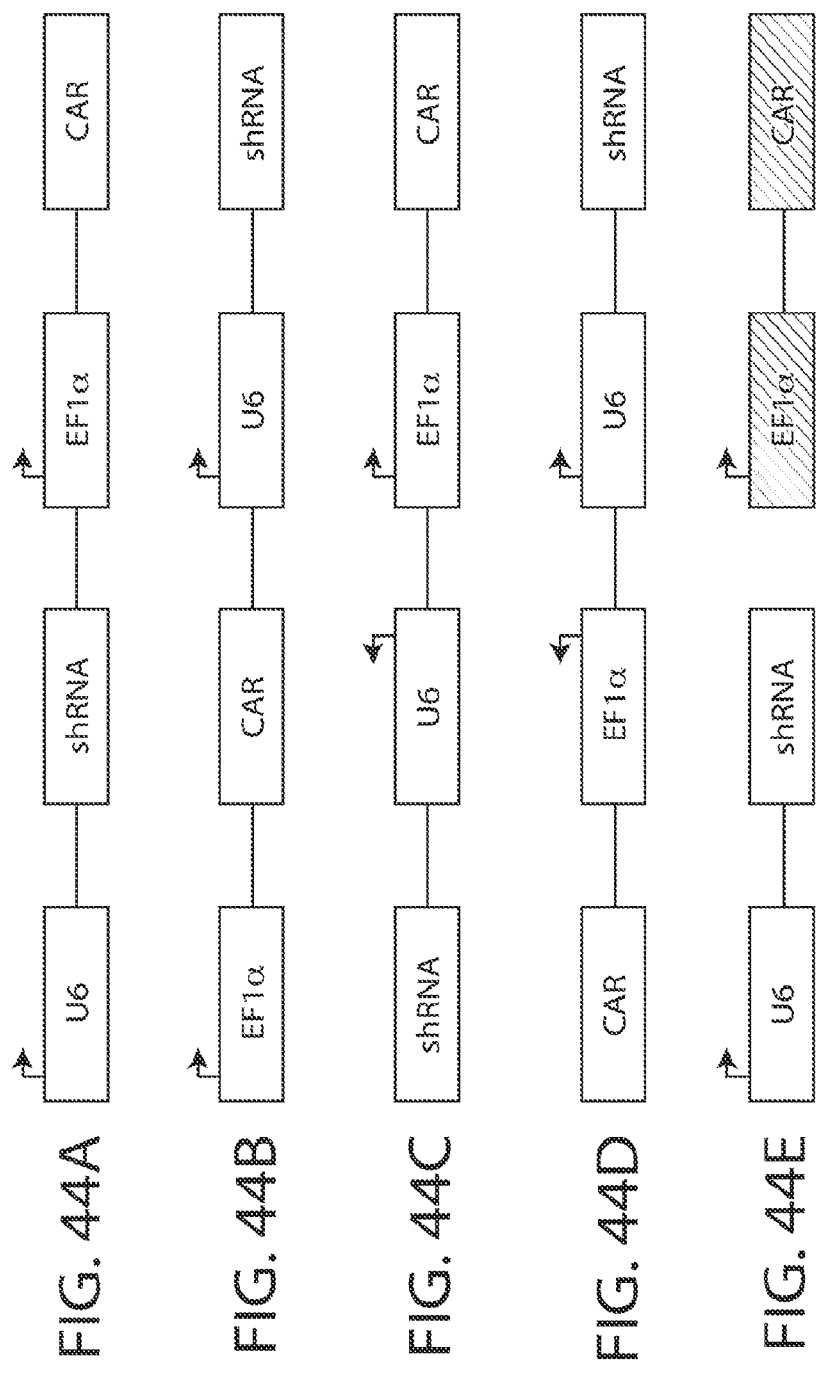

TARGETING CYTOTOXIC CELLS WITH CHIMERIC RECEPTORS FOR ADOPTIVE IMMUNOTHERAPY

RELATED APPLICATIONS

This application is a national stage application under 35 U.S.C. § 371 of International Application No. PCT/US2015/0050715, filed Sep. 17, 2015, published as International Publication No. WO2016/044605 on Mar. 24, 2016, which claims priority to PCT Application No. PCT/CN2014/086694, filed Sep. 17, 2014, and PCT Application No. PCT/CN2014/090578, filed Nov. 7, 2014. The entire contents of each of these applications are incorporated herein by reference.

SEQUENCE LISTING

The instant application contains a Sequence Listing which has been submitted electronically in ASCII format and is hereby incorporated by reference in its entirety. Said ASCII copy, created on Nov. 20, 2015, is named N2067-7068WO3_SL.txt and is 643,714 bytes in size.

BACKGROUND OF THE INVENTION

With the use of gene transfer technologies, T cells can be genetically modified to stably express antibody binding domains on their surface that endow the T cells with specificities that are independent of the constraints imposed by the major histocompatibility complex (MHC). Chimeric antigen receptors (CARs) represent synthetic proteins expressed on T-cells (CART cells) that fuse an antigen recognition fragment of an antibody (e.g., an scFv, or single-chain variable region fragment) with an intracellular domain of the CD3-zeta chain. Upon interaction with a target cell expressing the scFv's cognate antigen, CARs expressed on T cell cells can trigger T-cell activation leading to target cell killing (also referred to as target cell lysis). When combined with additional costimulatory signals such as the intracellular domain of CD137 or CD28, these receptors are also capable of generating proliferation. However, some of this proliferation appears to be antigen-independent, unlike normal T cell receptor (TCR) responses (Milone et al., 2009, Mol Ther 17(8):1453-64). Artificial receptors do not fully reproduce the intracellular signal transduction produced by natural TCR binding to antigenic peptide complexed with MHC molecules (Brocker, 2000, Blood 96(5):1999-2001). The signaling defects may limit the long-term survival of CART cells upon adoptive transfer in the absence of high levels of cytokines like IL-2 (Lo et al., 2010, Clin Cancer Res 16(10):2769-80). They also have altered regulation that might be beneficial in some anti-cancer applications (Loskog et al., 2006, Leukemia 20(10):1819-28), but these regulatory defects also lead to potential challenges to controlling their "off-target" activity against normal tissues that also express antigen, even at extremely low levels. These "off-target" effects are a serious limitation to CAR-based therapeutics, and have resulted in probable deaths during early Phase I evaluation of CAR-modified T cells (Morgan et al., 2010, Mol Ther 18(4):843-51).

Thus, there is a need in the art for alternative approaches for constructing CARs that overcome the limitations to current CAR-based therapeutics. The present invention addresses this unmet need in the art.

SUMMARY

In a first aspect, the invention features a purified, or non-naturally occurring, natural killer cell immune function receptor-chimeric antigen receptor (NKR-CAR) polypeptide comprising one, two or all of an extra-cellular antigen binding domain, a transmembrane domain, e.g., an NKR transmembrane domain, and a cytoplasmic domain, e.g., an NKR cytoplasmic domain. In one embodiment, the NKR-CAR polypeptide comprises an extracellular antigen binding domain, and one or both of: a transmembrane domain, e.g., a NKR transmembrane domain; or a cytoplasmic domain, e.g., a NKR cytoplasmic domain. In one embodiment, said NKR-CAR polypeptide comprises an extra-cellular antigen binding domain; a transmembrane domain and an NKR cytoplasmic domain. In one embodiment, the NKR-CAR polypeptide comprises an extracellular antigen binding domain, a NKR transmembrane domain and a cytoplasmic domain. In one embodiment, the NKR-CAR polypeptide comprises an extracellular antigen binding domain, a NKR transmembrane domain and a cytoplasmic domain.

In one embodiment, said NKR-CAR polypeptide comprises a KIR-CAR, e.g., an actKIR-CAR or inhKIR-CAR, a NCR-CAR, e.g., an actNCR-CAR, a SLAMF-CAR, e.g., an inhSLAMF-CAR, a FcR-CAR, e.g., CD16-CAR, e.g., an actCD16-CAR, or CD64-CAR, e.g., an actCD64-CAR, or a Ly49-CAR, e.g., an actLy49-CAR or inhLy49-CAR.

In one embodiment, the NKR-CAR polypeptide comprises a killer cell immunoglobulin-like receptor chimeric antigen receptor (KIR-CAR), wherein the KIR-CAR comprises one or both of a transmembrane domain from a KIR (a KIR transmembrane domain) or a cytoplasmic domain comprising a functional signaling domain from a KIR (a KIR cytoplasmic domain). In one embodiment, the KIR transmembrane domain comprises a transmembrane domain of a protein selected from the group consisting of: KIR2DS2, KIR2DL3, KIR2DL1, KIR2DL2, KIR2DL4, KIR2DL5A, KIR2DL5B, KIR2DS1, KIR2DS3, KIR2DS4, KIR2DS5, KIR3DL1, KIR3DS1, KIR3DL2, KIR3DL3, KIR2DP1 and KIR3DP1. In one embodiment, the KIR cytoplasmic domain comprises a functional signaling domain of a protein selected from the group consisting of: KIR2DS2, KIR2DL3, KIR2DL1, KIR2DL2, KIR2DL4, KIR2DL5A, KIR2DL5B, KIR2DS1, KIR2DS3, KIR2DS4, KIR2DS5, KIR3DL1, KIR3DS1, KIR3DL2, KIR3DL3, KIR2DP1 and KIR3DP1. In one embodiment, the KIR-CAR further comprises one or more of a KIR D0 domain, a KIR D1 domain, and/or a KIR D2 domain.

In one embodiment, the NKR CAR polypeptide comprises a natural cytotoxicity receptor chimeric antigen receptor (NCR-CAR), wherein the NCR-CAR comprises one or both of a transmembrane domain from a NCR (a NCR transmembrane domain) or a cytoplasmic domain comprising a functional signaling domain from a NCR (a NCR cytoplasmic domain). In one embodiment, the NCR transmembrane domain comprises a transmembrane domain of a protein selected from the group consisting of: NKp46, NKp30, and NKp44. In one embodiment, wherein the NCR cytoplasmic domain comprises a functional signaling domain of a protein selected from the group consisting of: NKp46, NKp30, and NKp44.

In one embodiment, the NKR CAR polypeptide comprises a signaling lymphocyte activation molecule family chimeric antigen receptor (SLAMF-CAR), wherein the SLAMF-CAR comprises one or both of a transmembrane domain from a SLAMF (a SLAMF transmembrane domain) or a cytoplasmic domain comprising a functional signaling domain from a SLAMF (a SLAMF cytoplasmic domain). In one embodiment, the SLAMF transmembrane domain comprises a transmembrane domain of a protein selected from the group consisting of: SLAM, CD48, CD229, 2B4, CD84, NTB-A, CRACC, BLAME, and CD2F-10. In one embodiment, the SLAMF cytoplasmic domain comprises a functional signaling domain of a protein selected from the group consisting of: SLAM, CD48, CD229, 2B4, CD84, NTB-A, CRACC, BLAME, and CD2F-10.

In one embodiment, the NKR CAR polypeptide comprises a Fc receptor chimeric antigen receptor (FcR-CAR), wherein the FcR-CAR comprises one or both of a transmembrane domain from a FcR selected from CD16 or CD64, or a cytoplasmic domain comprising a functional signaling domain from a FcR selected from CD16 or CD64.

In one embodiment, the NKR CAR polypeptide comprises a Ly49 receptor chimeric antigen receptor (Ly49-CAR), wherein the Ly49-CAR comprises one or both of a transmembrane domain from Ly49 (a Ly49 transmembrane domain) or a cytoplasmic domain comprising a functional signaling domain from Ly49 (a Ly49 cytoplasmic domain). In one embodiment, the Ly49 transmembrane domain comprises a transmembrane domain of a protein selected from the group consisting of: Ly49A, Ly49C, Ly49H, and Ly49D. In one embodiment, the Ly49 cytoplasmic domain comprises a functional signaling domain of a protein selected from the group consisting of: Ly49A, Ly49C, Ly49H, and Ly49D.

In one embodiment, the transmembrane domain of the NKR-CAR polypeptide is a NKR transmembrane domain, wherein the NKR transmembrane domain comprises a transmembrane domain of a protein selected from the group consisting of KIR2DS2, KIR2DL3, NKp46, a KIR, a NCR, a SLAMF, a FcR, and a Ly49. In one embodiment, the transmembrane domain comprises: i) the amino acid sequence of SEQ ID NOs: 357, 358, or 359; ii) an amino acid sequence comprising at least one, two, or three modifications but not more than 5 modifications of the amino acid sequence of SEQ ID NOs: 357, 358, or 359; or iii) an amino acid sequence with 95-99% sequence identity to SEQ ID NOs: 357, 358, or 359.

In one embodiment, the encoded transmembrane domain of the NKR-CAR polypeptide is a transmembrane domain e.g., a transmembrane domain of a TCAR as described herein, comprising the transmembrane domain of a protein selected from the group consisting of TCR zeta, FcR gamma, FcR beta, CD3 gamma, CD3 delta, CD3 epsilon, CD5, CD22, CD79a, CD79b, CD278 (also known as "ICOS"), FcεRI, CD66d, DAP10, DAP12, the alpha, beta or zeta chain of the T-cell receptor, a MHC class I molecule, a TNF receptor protein, an Immunoglobulin-like protein, a cytokine receptor, an integrin, an activating NK cell receptor, BTLA, a Toll ligand receptor, CD28, CD3 epsilon, CD45, CD4, CD5, CD8 (CD8 alpha or CD8 beta), CD9, CD16, CD22, CD33, CD37, CD64, CD80, CD86, CD134, CD137, CD154, OX40, CD2, CD7, CD27, CD28, CD30, CD40, CDS, ICAM-1, LFA-1 (CD11a/CD18), 4-1BB (CD137), B7-H3, CDS, ICAM-1, ICOS (CD278), GITR, BAFFR, LIGHT, HVEM (LIGHTR), KIRDS2, SLAMF7, NKp80 (KLRF1), NKp44, NKp30, NKp46, CD19, CD4, CD8alpha, CD8beta, IL2R beta, IL2R gamma, IL7R alpha, ITGA4, VLA1, CD49a, ITGA4, IA4, CD49D, ITGA6, VLA-6, CD49f, ITGAD, CD11d, ITGAE, CD103, ITGAL, CD11a, LFA-1, ITGAM, CD11b, ITGAX, CD11c, ITGB1, CD29, ITGB2, CD18, LFA-1, ITGB7, NKG2D, NKG2C, TNFR2, TRANCE/RANKL, DNAM1 (CD226), SLAMF4 (CD244, 2B4), CD84, CD96 (Tactile), CEACAM1, CRTAM, Ly9 (CD229), CD160 (BY55), PSGL1, CD100 (SEMA4D), CD69, SLAMF6 (NTB-A, Ly108), SLAM (SLAMF1, CD150, IPO-3), BLAME (SLAMF8), SELPLG (CD162), LTBR, LAT, GADS, SLP-76, PAG/Cbp, CD19a, and a ligand that specifically binds with CD83, or any combination thereof.

In one embodiment, the cytoplasmic domain of the NKR-CAR polypeptide is a NKR cytoplasmic domain comprising one or more functional signaling domain of a protein selected from the group consisting of KIR2DS2, KIR2DL3, NKp46, a KIR, a NCR, a SLAMF, a FcR, and a Ly49. In one embodiment, the cytoplasmic domain comprises: i) the amino acid sequence of SEQ ID NOs: 360, 361, or 362; ii) an amino acid sequence comprising at least one, two, or three modifications but not more than 20, 10, or 5 modifications of the amino acid sequence of SEQ ID NOs: 360, 361, or 362; or iii) an amino acid sequence with 95-99% sequence identity to SEQ ID NOs: 360, 361.

In one embodiment, the cytoplasmic domain of the NKR-CAR polypeptide comprises an intracellular signaling domain or adaptor molecule, e.g., DAP12. In one embodiment, the encoded cytoplasmic domain of the NKR-CAR polypeptide comprises an adaptor molecule, e.g., DAP12 or FcεRγ. In one embodiment, the cytoplasmic domain comprises: i) the encoded adaptor molecule comprises the amino acid sequence of amino acids 1-113 of SEQ ID NO: 333 or amino acids 1-86 of SEQ ID NO: 335; ii) an amino acid sequence having at least one, two or three modifications but not more than 20, 10, or 5 modifications to amino acids 1-113 of SEQ ID NO: 333 or amino acids 1-86 of SEQ ID NO: 335; or iii) an amino acid sequence with 95-99% identity to amino acids 1-113 of SEQ ID NO: 333 or amino acids 1-86 of SEQ ID NO: 335. In one embodiment, the NKR-CAR comprises an antigen binding domain described herein, a CD8 transmembrane domain, and a cytoplasmic domain comprising DAP12.

In one embodiment, the cytoplasmic domain of the NKR-CAR polypeptide is a cytoplasmic domain e.g., of a TCAR as described herein, comprising one or more functional signaling domain of a protein selected from the group consisting of TCR zeta, FcR gamma, FcR beta, CD3 gamma, CD3 delta, CD3 epsilon, CD5, CD22, CD79a, CD79b, CD278 (also known as "ICOS"), FcεRI, CD66d, DAP10, DAP12, the alpha, beta or zeta chain of the T-cell receptor, a MHC class I molecule, a TNF receptor protein, an Immunoglobulin-like protein, a cytokine receptor, an integrin, an activating NK cell receptor, BTLA, a Toll ligand receptor, CD28, CD3 epsilon, CD45, CD4, CD5, CD8 (CD8 alpha or CD8 beta), CD9, CD16, CD22, CD33, CD37, CD64, CD80, CD86, CD134, CD137, CD154, OX40, CD2, CD7, CD27, CD28, CD30, CD40, CDS, ICAM-1, LFA-1 (CD11a/CD18), 4-1BB (CD137), B7-H3, CDS, ICAM-1, ICOS (CD278), GITR, BAFFR, LIGHT, HVEM (LIGHTR), KIRDS2, SLAMF7, NKp80 (KLRF1), NKp44, NKp30, NKp46, CD19, CD4, CD8alpha, CD8beta, IL2R beta, IL2R gamma, IL7R alpha, ITGA4, VLA1, CD49a, ITGA4, IA4, CD49D, ITGA6, VLA-6, CD49f, ITGAD, CD11d, ITGAE, CD103, ITGAL, CD11a, LFA-1, ITGAM, CD11b, ITGAX, CD11c, ITGB1, CD29, ITGB2, CD18, LFA-1, ITGB7, NKG2D, NKG2C, TNFR2, TRANCE/RANKL, DNAM1 (CD226), SLAMF4 (CD244, 2B4), CD84, CD96 (Tactile), CEACAM1, CRTAM, Ly9 (CD229), CD160 (BY55), PSGL1, CD100 (SEMA4D), CD69, SLAMF6 (NTB-A, Ly108), SLAM (SLAMF1, CD150, IPO-3), BLAME (SLAMF8), SELPLG (CD162), LTBR, LAT, GADS, SLP-76, PAG/Cbp, CD19a, and a ligand that specifically binds with CD83, or any combination thereof.

In one embodiment, the NKR-CAR polypeptide further comprises a leader sequence or signal sequence, e.g., comprising the amino acid sequence of SEQ ID NO: 1.

In one embodiment, the NKR-CAR comprises a transmembrane domain and an extra-cellular antigen binding domain, and further comprising a hinge domain disposed between said transmembrane domain and said extra-cellular antigen binding domain. In one embodiment, the hinge domain is selected from the group consisting of a GS hinge, a CD8 hinge, an IgG4 hinge, an IgD hinge, a KIR2DS2 hinge, a KIR hinge, a NCR hinge, a SLAMF hinge, a CD16 hinge, a CD64 hinge, and a LY49 hinge. In one embodiment, the hinge domain comprises: i) the amino acid sequence of SEQ ID NOs: 5, 2, 3, or 4; ii) an amino acid sequence comprising at least one, two, or three modifications but not more than 5 modifications of the amino acid sequence of SEQ ID NOs: 5, 2, 3, or 4; or iii) an amino acid sequence with 95-99% identity to the amino acid sequence of SEQ ID NOs: 5, 2, 3, or 4.

In an embodiment, the transmembrane domain and cytoplasmic domain collectively comprise: i) the amino acid sequence of amino acids 413-487 of SEQ ID NO: 333 or amino acids 386-454 of SEQ ID NO: 335, or SEQ ID NO: 371; ii) an amino acid sequence having at least one, two or three modifications but not more than 30, 20 or 10 modifications to amino acids 413-487 of SEQ ID NO: 333 or amino acids 386-454 of SEQ ID NO: 335, or SEQ ID NO: 371; or iii) an amino acid sequence with 95-99% identity to amino acids 413-487 of SEQ ID NO: 333 or amino acids 386-454 of SEQ ID NO: 335, or SEQ ID NO: 371.

In any of the foregoing embodiments, the NKR-CAR is an activating NKR-CAR, and the extra-cellular antigen binding domain is an antigen binding domain described herein, e.g., in Table 4. In any of the foregoing embodiments, the extracellular antigen binding domain is a non-murine antigen binding domain that binds to mesothelin. In one embodiment, the extracellular non-murine antigen binding domain that binds to mesothelin comprises a human or humanized antigen binding domain that binds to mesothelin. In one embodiment, the human or humanized antigen binding domain that binds to mesothelin is provided in Table 4.

In one embodiment, the human antigen binding domain that binds mesothelin comprises: a heavy chain complementarity determining region 1 (HC CDR1), a heavy chain complementary determining region 2 (HC CDR2), and a heavy chain complementary determining region 3 (HC CDR3) of any human anti-mesothelin heavy chain amino acid sequence listed in Table 4; and/or a light chain complementarity determining region 1 (LC CDR1), a light chain complementary determining region 2 (LC CDR2), and a light chain complementary determining region 3 (LC CDR3) of any human anti-mesothelin light chain amino acid sequence listed in Table 4. In one embodiment, the human antigen binding domain that binds mesothelin comprises: a heavy chain variable region comprising: i) the amino acid sequence of any human anti-mesothelin heavy chain variable region listed in Table 4; ii) an amino acid sequence having at least at least one, two or three modifications but not more than 30, 20 or 10 modifications to the amino acid sequence of any human anti-mesothelin heavy chain variable region listed in Table 4; or iii) an amino acid sequence with 95-99% identity to the amino acid sequence of any human anti-mesothelin heavy chain variable region listed in Table 4; and/or a light chain variable region comprising: i) the amino acid sequence of any human anti-mesothelin light chain variable region listed in Table 4; ii) an amino acid sequence having at least at least one, two or three modifications but not more than 30, 20 or 10 modifications to the amino acid sequence of any human anti-mesothelin light chain variable region listed in Table 4; or iii) an amino acid sequence with 95-99% identity to the amino acid sequence of any human anti-mesothelin light chain variable region listed in Table 4. In one embodiment, the human antigen binding domain that binds mesothelin comprises: i) the amino acid sequence of any of SEQ ID NOs: 230-253; ii) an amino acid sequence having at least one, two or three modifications but not more than 30, 20 or 10 modifications to any of SEQ ID NOs: 230-253; or iii) an amino acid sequence with 95-99% identity to any of SEQ ID NOs: 230-253. In such embodiments, the NKR-CAR further comprises, e.g., a transmembrane and cytoplasmic domain collectively comprising, the amino acid sequence of SEQ ID NO: 371, an amino acid sequence having at least one, two or three modifications but not more than 10 or 5 modifications to SEQ ID NO: 371, or an amino acid sequence having at least 95-99% sequence identity to SEQ ID NO: 371.

In a first aspect, the invention features a purified, or non-naturally occurring, nucleic acid molecule encoding a natural killer cell immune function receptor-chimeric antigen receptor (NKR-CAR) polypeptide described herein, e.g., comprising one, two or all of an extra-cellular antigen binding domain, a transmembrane domain, e.g., an NKR transmembrane domain, and a cytoplasmic domain, e.g., an NKR cytoplasmic domain. In one embodiment, the nucleic acid molecule encoding a NKR-CAR comprises an extra-cellular antigen binding domain, and one or both of: a transmembrane domain, e.g., a NKR transmembrane domain; or a cytoplasmic domain, e.g., a NKR cytoplasmic domain. In one embodiment, the nucleic acid molecule encoding a NKR-CAR comprises an extra-cellular antigen binding domain; a transmembrane domain and an NKR cytoplasmic domain. In one embodiment, the nucleic acid molecule encoding a NKR-CAR comprises an extracellular antigen binding domain, a NKR transmembrane domain and a cytoplasmic domain. In one embodiment, the nucleic acid molecule encoding a NKR-CAR comprises an extracellular antigen binding domain, a NKR transmembrane domain and a cytoplasmic domain.

In one embodiment, the nucleic acid molecule encodes a NKR-CAR comprising a KIR-CAR, e.g., an actKIR-CAR or inhKIR-CAR, a NCR-CAR, e.g., an actNCR-CAR, a SLAMF-CAR, e.g., an inhSLAMF-CAR, a FcR-CAR, e.g., CD16-CAR, e.g., an actCD16-CAR, or CD64-CAR, e.g., an actCD64-CAR, or a Ly49-CAR, e.g., an actLy49-CAR or inhLy49-CAR.

In one embodiment, the encoded KIR-CAR comprises one or both of a transmembrane domain from a KIR (a KIR transmembrane domain) or a cytoplasmic domain comprising a functional signaling domain from a KIR (a KIR cytoplasmic domain). In one embodiment, the KIR transmembrane domain comprises a transmembrane domain of a protein selected from the group consisting of: KIR2DS2, KIR2DL3, KIR2DL1, KIR2DL2, KIR2DL4, KIR2DL5A, KIR2DL5B, KIR2DS1, KIR2DS3, KIR2DS4, KIR2DS5, KIR3DL1, KIR3DS1, KIR3DL2, KIR3DL3, KIR2DP1 and KIR3DP1. In one embodiment, the KIR cytoplasmic domain comprises a functional signaling domain of a protein selected from the group consisting of: KIR2DS2, KIR2DL3, KIR2DL1, KIR2DL2, KIR2DL4, KIR2DL5A, KIR2DL5B, KIR2DS1, KIR2DS3, KIR2DS4, KIR2DS5, KIR3DL1, KIR3DS1, KIR3DL2, KIR3DL3, KIR2DP1 and KIR3DP1. In one embodiment, the KIR-CAR further comprises one or more of a KIR D0 domain, a KIR D1 domain, and/or a KIR D2 domain.

In one embodiment, the encoded NCR-CAR comprises one or both of a transmembrane domain from a NCR (a NCR transmembrane domain) or a cytoplasmic domain comprising a functional signaling domain from a NCR (a NCR cytoplasmic domain). In one embodiment, the NCR transmembrane domain comprises a transmembrane domain of a protein selected from the group consisting of: NKp46, NKp30, and NKp44. In one embodiment, wherein the NCR cytoplasmic domain comprises a functional signaling domain of a protein selected from the group consisting of: NKp46, NKp30, and NKp44.

In one embodiment, the encoded SLAMF-CAR comprises one or both of a transmembrane domain from a SLAMF (a SLAMF transmembrane domain) or a cytoplasmic domain comprising a functional signaling domain from a SLAMF (a SLAMF cytoplasmic domain). In one embodiment, the SLAMF transmembrane domain comprises a transmembrane domain of a protein selected from the group consisting of: SLAM, CD48, CD229, 2B4, CD84, NTB-A, CRACC, BLAME, and CD2F-10. In one embodiment, the SLAMF cytoplasmic domain comprises a functional signaling domain of a protein selected from the group consisting of: SLAM, CD48, CD229, 2B4, CD84, NTB-A, CRACC, BLAME, and CD2F-10.

In one embodiment, the encoded FcR-CAR comprises one or both of a transmembrane domain from a FcR selected from CD16 or CD64, or a cytoplasmic domain comprising a functional signaling domain from a FcR selected from CD16 or CD64.

In one embodiment, the encoded Ly49-CAR comprises one or both of a transmembrane domain from Ly49 (a Ly49 transmembrane domain) or a cytoplasmic domain comprising a functional signaling domain from Ly49 (a Ly49 cytoplasmic domain). In one embodiment, the Ly49 transmembrane domain comprises a transmembrane domain of a protein selected from the group consisting of: Ly49A, Ly49C, Ly49H, and Ly49D. In one embodiment, the Ly49 cytoplasmic domain comprises a functional signaling domain of a protein selected from the group consisting of: Ly49A, Ly49C, Ly49H, and Ly49D.

In one embodiment, the encoded transmembrane domain of the NKR-CAR is a NKR transmembrane domain, wherein the NKR transmembrane domain comprises a transmembrane domain of a protein selected from the group consisting of KIR2DS2, KIR2DL3, NKp46, a KIR, a NCR, a SLAMF, a FcR, and a Ly49. In one embodiment, the encoded transmembrane domain of the NKR-CAR comprises the amino acid sequence of SEQ ID NOs: 357, 358, or 359; an amino acid sequence comprising at least one, two, or three modifications but not more than 5 modifications of the amino acid sequence of SEQ ID NOs: 357, 358, or 359; or an amino acid sequence with 95-99% sequence identity to SEQ ID NOs: 357, 358, or 359. In one embodiment, the nucleic acid molecule encoding a NKR-CAR comprises a nucleic acid sequence comprising nucleotides 803-875 of SEQ ID NO: 347, or a nucleic acid sequence with 95-99% sequence identity thereof, which encodes a transmembrane domain.

In one embodiment, the encoded transmembrane domain of the NKR-CAR polypeptide is a transmembrane domain e.g., of a TCAR as described herein, comprising the transmembrane domain of a protein selected from the group consisting of TCR zeta, FcR gamma, FcR beta, CD3 gamma, CD3 delta, CD3 epsilon, CD5, CD22, CD79a, CD79b, CD278 (also known as "ICOS"), FcεRI, CD66d, DAP10, DAP12, the alpha, beta or zeta chain of the T-cell receptor, a MHC class I molecule, a TNF receptor protein, an Immunoglobulin-like protein, a cytokine receptor, an integrin, an activating NK cell receptor, BTLA, a Toll ligand receptor, CD28, CD3 epsilon, CD45, CD4, CD5, CD8 (CD8 alpha or CD8 beta), CD9, CD16, CD22, CD33, CD37, CD64, CD80, CD86, CD134, CD137, CD154, OX40, CD2, CD7, CD27, CD28, CD30, CD40, CDS, ICAM-1, LFA-1 (CD11a/CD18), 4-1BB (CD137), B7-H3, CDS, ICAM-1, ICOS (CD278), GITR, BAFFR, LIGHT, HVEM (LIGHTR), KIRDS2, SLAMF7, NKp80 (KLRF1), NKp44, NKp30, NKp46, CD19, CD4, CD8alpha, CD8beta, IL2R beta, IL2R gamma, IL7R alpha, ITGA4, VLA1, CD49a, ITGA4, IA4, CD49D, ITGA6, VLA-6, CD49f, ITGAD, CD11d, ITGAE, CD103, ITGAL, CD11a, LFA-1, ITGAM, CD11b, ITGAX, CD11c, ITGB1, CD29, ITGB2, CD18, LFA-1, ITGB7, NKG2D, NKG2C, TNFR2, TRANCE/RANKL, DNAM1 (CD226), SLAMF4 (CD244, 2B4), CD84, CD96 (Tactile), CEACAM1, CRTAM, Ly9 (CD229), CD160 (BY55), PSGL1, CD100 (SEMA4D), CD69, SLAMF6 (NTB-A, Ly108), SLAM (SLAMF1, CD150, IPO-3), BLAME (SLAMF8), SELPLG (CD162), LTBR, LAT, GADS, SLP-76, PAG/Cbp, CD19a, and a ligand that specifically binds with CD83, or any combination thereof.

In one embodiment, the encoded cytoplasmic domain of the NKR-CAR is a NKR cytoplasmic domain, wherein the NKR cytoplasmic domain comprises one or more functional signaling domain of a protein selected from the group consisting of KIR2DS2, KIR2DL3, NKp46, a KIR, a NCR, a SLAMF, a FcR, and a Ly49. In one embodiment, the encoded cytoplasmic domain comprises: i) the amino acid sequence of SEQ ID NOs: 360, 361, or 362; ii) an amino acid sequence comprising at least one, two, or three modifications but not more than 20, 10, or 5 modifications of the amino acid sequence of SEQ ID NOs: 360, 361, or 362; or iii) an amino acid sequence with 95-99% sequence identity to SEQ ID NOs: 360, 361. In one embodiment, the nucleic acid molecule encoding a NKR-CAR comprises a nucleic acid sequence comprising nucleotides 831-947 of SEQ ID NO: 343, nucleotides 833-1060 of SEQ ID NO: 345, or nucleotides 876-949 of SEQ ID NO: 347, or a nucleic acid sequence with 95-99% sequence identity thereof, which encodes a cytoplasmic domain.

In one embodiment, the encoded cytoplasmic domain of the NKR-CAR polypeptide comprises an intracellular signaling domain or adaptor molecule, e.g., DAP12. In one embodiment, the encoded cytoplasmic domain of the NKR-CAR polypeptide comprises an adaptor molecule, e.g., DAP12 or FcεRγ. In one embodiment, the encoded cytoplasmic domain comprises: i) the encoded adaptor molecule comprises the amino acid sequence of amino acids 1-113 of SEQ ID NO: 333 or amino acids 1-86 of SEQ ID NO: 335; ii) an amino acid sequence having at least one, two or three modifications but not more than 20, 10, or 5 modifications to amino acids 1-113 of SEQ ID NO: 333 or amino acids 1-86 of SEQ ID NO: 335; or iii) an amino acid sequence with 95-99% identity to amino acids 1-113 of SEQ ID NO: 333 or amino acids 1-86 of SEQ ID NO: 335. In one embodiment, the nucleic acid molecule encoding a NKR-CAR comprises a nucleic acid sequence comprising nucleotides comprises nucleotides 1-339 of SEQ ID NO: 332 or nucleotides 1-258 of SEQ ID NO: 334, or a nucleic acid sequence comprising 95-99% identity thereto, which encode an adaptor molecule. In one embodiment, the NKR-CAR comprises an antigen binding domain described herein, a CD8 transmembrane domain, and a cytoplasmic domain comprising DAP12.

In one embodiment, the encoded cytoplasmic domain of the NKR-CAR polypeptide is a cytoplasmic domain, e.g., of a TCAR as described herein, comprising one or more functional signaling domain of a protein selected from the group consisting of TCR zeta, FcR gamma, FcR beta, CD3 gamma, CD3 delta, CD3 epsilon, CD5, CD22, CD79a, CD79b, CD278 (also known as "ICOS"), FcεRI, CD66d, DAP10, DAP12, the alpha, beta or zeta chain of the T-cell receptor, a MHC class I molecule, a TNF receptor protein, an Immunoglobulin-like protein, a cytokine receptor, an integrin, an activating NK cell receptor, BTLA, a Toll ligand receptor, CD28, CD3 epsilon, CD45, CD4, CD5, CD8 (CD8 alpha or CD8 beta), CD9, CD16, CD22, CD33, CD37, CD64, CD80, CD86, CD134, CD137, CD154, OX40, CD2, CD7, CD27, CD28, CD30, CD40, CDS, ICAM-1, LFA-1 (CD11a/CD18), 4-1BB (CD137), B7-H3, CDS, ICAM-1, ICOS (CD278), GITR, BAFFR, LIGHT, HVEM (LIGHTR), KIRDS2, SLAMF7, NKp80 (KLRF1), NKp44, NKp30, NKp46, CD19, CD4, CD8alpha, CD8beta, IL2R beta, IL2R gamma, IL7R alpha, ITGA4, VLA1, CD49a, ITGA4, IA4, CD49D, ITGA6, VLA-6, CD49f, ITGAD, CD11d, ITGAE, CD103, ITGAL, CD11a, LFA-1, ITGAM, CD11b, ITGAX, CD11c, ITGB1, CD29, ITGB2, CD18, LFA-1, ITGB7, NKG2D, NKG2C, TNFR2, TRANCE/RANKL, DNAM1 (CD226), SLAMF4 (CD244, 2B4), CD84, CD96 (Tactile), CEACAM1, CRTAM, Ly9 (CD229), CD160 (BY55), PSGL1, CD100 (SEMA4D), CD69, SLAMF6 (NTB-A, Ly108), SLAM (SLAMF1, CD150, IPO-3), BLAME (SLAMF8), SELPLG (CD162), LTBR, LAT, GADS, SLP-76, PAG/Cbp, CD19a, and a ligand that specifically binds with CD83, or any combination thereof.

In one embodiment, the nucleic acid molecule encoding a NKR-CAR further comprises a leader sequence or signal sequence which encodes the amino acid sequence of SEQ ID NO: 1.

In one embodiment, the encoded NKR-CAR comprises the extracellular antigen binding domain connected to the transmembrane domain by a hinge domain. In one embodiment, the hinge domain is selected from the group consisting of, a GS hinge, a CD8 hinge an IgG4 hinge, an IgD hinge, a KIR2DS2 hinge, a KIR hinge, a NCR hinge, a SLAMF hinge, a CD16 hinge, a CD64 hinge, and a LY49 hinge. In one embodiment, the encoded hinge domain comprises: i) the amino acid sequence of SEQ ID NOs: 5, 2, 3, or 4; ii) an amino acid sequence comprising at least one, two, or three modifications but not more than 5 modifications of the amino acid sequence of SEQ ID NOs: 5, 2, 3, or 4; or iii) an amino acid sequence with 95-99% identity to the amino acid sequence of SEQ ID NOs: 5, 2, 3, or 4. In one embodiment, the nucleic acid molecule encoding a NKR-CAR comprises a nucleic acid sequence comprising the nucleic acid sequence of SEQ ID NO: 356, 16, 13, 14, or 15, or a nucleic acid sequence with 95-99% identity thereof, which encodes a hinge domain.

In an embodiment, the encoded transmembrane domain and encoded cytoplasmic domain collectively comprise: i) the amino acid sequence of amino acids 413-487 of SEQ ID NO: 333 or amino acids 386-454 of SEQ ID NO: 335, or SEQ ID NO: 371; ii) an amino acid sequence having at least one, two or three modifications but not more than 30, 20 or 10 modifications to amino acids 413-487 of SEQ ID NO: 333 or amino acids 386-454 of SEQ ID NO: 335, or SEQ ID NO: 371; or iii) an amino acid sequence with 95-99% identity to amino acids 413-487 of SEQ ID NO: 333 or amino acids 386-454 of SEQ ID NO: 335, or SEQ ID NO: 371. In one embodiment, the nucleic acid molecule encoding a NKR-CAR comprises a nucleic acid sequence comprising nucleotides 1237-1464 of SEQ ID NO: 332 or nucleotides 1156-1365 of SEQ ID NO: 334, or a sequence having 95-99% identity thereof, which encodes the transmembrane and cytoplasmic domain collectively.

In another aspect, the invention features a nucleic acid molecule, e.g., a purified or non-naturally occurring, nucleic acid, e.g., a nucleic acid comprising a DNA, or RNA, sequence, e.g., a mRNA, comprising a sequence that encodes a NKR-CAR described herein.

In one embodiment, the nucleic acid molecule further comprises a nucleic acid sequence that encodes an adaptor molecule or intracellular signaling domain that interacts with said NKR-CAR. In one embodiment, the encoded adaptor molecule comprises a functional signaling domain of DAP12 or FcεRγ. In one embodiment, the encoded adaptor molecule comprises the amino acid sequence of amino acids 1-113 of SEQ ID NO: 333 or amino acids 1-86 of SEQ ID NO: 335; an amino acid sequence having at least one, two or three modifications but not more than 20, 10, or 5 modifications to amino acids 1-113 of SEQ ID NO: 333 or amino acids 1-86 of SEQ ID NO: 335; or an amino acid sequence with 95-99% identity to amino acids 1-113 of SEQ ID NO: 333 or amino acids 1-86 of SEQ ID NO: 335. In one embodiment, the nucleic acid molecule encoding a NKR-CAR comprises a nucleic acid sequence comprising the nucleotides 1-339 of SEQ ID NO: 332 or nucleotides 1-258 of SEQ ID NO: 334, or a nucleic acid sequence comprising 95-99% identity thereof, which encodes an adaptor molecule.

In one embodiment, the nucleic acid molecule further comprises a nucleic acid sequence encoding a TCAR or a second NKR-CAR. In one embodiment, the encoded TCAR or the encoded second NKR-CAR comprises an antigen binding domain that binds to a target antigen that is not mesothelin.

In one embodiment, the nucleic acid molecule encoding the NKR-CAR further comprises a nucleic acid sequence encoding a peptide cleavage site selected from the group consisting of T2A, P2A, E2A, and F2A, wherein the nucleic acid encoding the peptide cleavage site links the nucleic acid sequence encoding the NKR-CAR to a second nucleic acid sequence, e.g., the nucleic acid sequence encoding the adaptor molecule. In one embodiment, the nucleic acid sequence encodes the peptide cleavage site encodes an amino acid sequence of SEQ ID NOs: 57, 58, 59, or 60; or an amino acid sequence having 95-99% sequence identity thereto.

In one embodiment, the nucleic acid encodes an activating NKR-CAR, and the encoded extra-cellular antigen binding domain is an antigen binding domain described herein, e.g., in Table 4. In any of the foregoing embodiments, the encoded extracellular antigen binding domain is a non-murine antigen binding domain that binds to mesothelin. In one embodiment, the encoded extracellular non-murine antigen binding domain that binds to mesothelin comprises a human or humanized antigen binding domain that binds to mesothelin. In one embodiment, the human or humanized antigen binding domain that binds to mesothelin is provided in Table 4.

In one embodiment, the encoded human antigen binding domain that binds mesothelin comprises: a heavy chain complementarity determining region 1 (HC CDR1), a heavy chain complementary determining region 2 (HC CDR2), and a heavy chain complementary determining region 3 (HC CDR3) of any human anti-mesothelin heavy chain amino acid sequence listed in Table 4; and/or a light chain complementarity determining region 1 (LC CDR1), a light chain complementary determining region 2 (LC CDR2), and a light chain complementary determining region 3 (LC CDR3) of any human anti-mesothelin light chain amino acid sequence listed in Table 4. In one embodiment, the encoded human antigen binding domain that binds mesothelin comprises: a heavy chain variable region comprising: i) the amino acid sequence of any human anti-mesothelin heavy chain variable region listed in Table 4; ii) an amino acid sequence having at least at least one, two or three modifications but not more than 30, 20 or 10 modifications to the amino acid sequence of any human anti-mesothelin heavy chain variable region listed in Table 4; or iii) an amino acid sequence with 95-99% identity to the amino acid sequence of any human anti-mesothelin heavy chain variable region listed in Table 4; and/or a light chain variable region comprising: i) the amino acid sequence of any human anti-mesothelin light chain variable region listed in Table 4; ii) an amino acid sequence having at least at least one, two or three modifications but not more than 30, 20 or 10 modifications to the amino acid sequence of any human anti-mesothelin light chain variable region listed in Table 4; or iii) an amino acid sequence with 95-99% identity to the amino acid sequence of any human anti-mesothelin light chain variable region listed in Table 4. In one embodiment, the encoded human antigen binding domain that binds mesothelin comprises: i) the amino acid sequence of any of SEQ ID NOs: 230-253; ii) an amino acid sequence having at least one, two or three modifications but not more than 30, 20 or 10 modifications to any of SEQ ID NOs: 230-253; or iii) an amino acid sequence with 95-99% identity to any of SEQ ID NOs: 230-253. In such embodiments, the NKR-CAR further comprises, e.g., a transmembrane and cytoplasmic domain collectively comprising, the amino acid sequence of SEQ ID NO: 371, an amino acid sequence having at least one, two or three modifications but not more than 10 or 5 modifications to SEQ ID NO: 371, or an amino acid sequence having at least 95-99% sequence identity to SEQ ID NO: 371.

In another aspect, the invention features a vector comprising a nucleic acid molecule encoding a NKR-CAR described herein. In one embodiment, the vector is a DNA vector or an RNA vector. In one embodiment, the vector is selected from the group consisting of a plasmid, a lentiviral vector, an adenoviral vector, and a retroviral vector. In one embodiment, the vector further comprises a nucleic acid sequence that encodes an adaptor molecule or intracellular signaling domain described herein. In one embodiment, the vector further comprises a promoter described herein, e.g., an EF-1 promoter, e.g., comprising the sequence of SEQ ID NO: 11.

In another aspect, the invention features a cell, e.g., an immune effector cell, e.g., a cytotoxic cell, e.g., a naturally or non-naturally occurring T cell, NK cell or cytotoxic T cell or NK cell line comprising a NKR-CAR described herein, a nucleic acid molecule encoding a NKR-CAR described herein, a vector described herein, or an NKR-CAR complex described herein.

In one embodiment, the cytotoxic cell further comprises an adaptor molecule or intracellular signaling domain that interacts with said NKR-CAR.

In another aspect, the invention features a method of making a cell described herein, e.g., an immune effector cell, e.g., a cytotoxic cell, e.g., a naturally or non-naturally occurring T cell, NK cell or cytotoxic T cell or NK cell line comprising a NKR-CAR, described herein comprising introducing into a cytotoxic cell a nucleic acid, e.g., a mRNA, comprising a sequence that encodes a NKR-CAR, described herein. In one embodiment, the method further comprises making a NKR-CAR, described herein, in the cytotoxic cell. In one embodiment, the method comprises making a population of a cell described herein, e.g., a population of immune effector cells, comprising an NKR-CAR described herein.

In another aspect, the invention features a method of treating a subject, e.g., a method of providing an anti-tumor immunity in a mammal, comprising administering to the mammal an effective amount of a cell described herein or a population of cells described herein, e.g., a cytotoxic cell, e.g., a naturally or non-naturally occurring T cell, NK cell or cytotoxic T cell or NK cell line comprising a NKR-CAR described herein.

In another aspect, the invention features a method of treating a subject having a disease associated with expression of tumor antigen, e.g., a tumor antigen described herein (e.g., a proliferative disease, a precancerous condition, and a noncancer related indication associated with the expression of a tumor antigen) comprising administering to the subject an effective amount of a cell comprising a NKR-CAR, e.g., as described herein. In one embodiment, the NKR-CAR is an activating NKR-CAR and the extra-cellular antigen binding domain is an antigen binding domain described herein, e.g., in Table 4. In one embodiment, the method further comprises administering a cell comprising a TCAR, e.g., as described herein.

In one embodiment, the disease associated with expression of a tumor antigen is cancer, e.g., a cancer described herein. In one embodiment, the cancer is a solid tumor, e.g., a solid tumor described herein.

In one embodiment, the disease or disorder is associated with the expression of mesothelin, e.g., mesothelioma (e.g., malignant pleural mesothelioma), lung cancer (e.g., non-small cell lung cancer, small cell lung cancer, squamous cell lung cancer, or large cell lung cancer), pancreatic cancer (e.g., pancreatic ductal adenocarcinoma), ovarian cancer, colorectal cancer and bladder cancer, or any combination thereof. In one embodiment, the disease is pancreatic cancer, e.g., metastatic pancreatic ductal adenocarcinoma (PDA), e.g., in a subject who has progressed on at least one prior standard therapy. In one embodiment, the disease is mesothelioma (e.g., malignant pleural mesothelioma), e.g., in a subject who has progressed on at least one prior standard therapy. In one embodiment, the disease is ovarian cancer, e.g., serous epithelial ovarian cancer, e.g., in a subject who has progressed after at least one prior regimen of standard therapy.

Additional features and embodiments of the aforesaid compositions and methods include one or more of the following:

In another aspect, the invention features a purified, or non-naturally occurring, KIR-CAR comprising an extra-cellular antigen binding domain and a transmembrane domain, e.g., a KIR transmembrane domain, or cytoplasmic domain, e.g., an ITIM-containing cytoplasmic domain, or a KIR-cytoplasmic domain. In one embodiment, the KIR-CAR comprises an extra-cellular antigen binding domain, a transmembrane domain, and an ITIM-containing cytoplasmic domain, or a KIR-cytoplasmic domain.

In one embodiment, said transmembrane domain can interact with, e.g., bind, the transmembrane domain of DAP12. In one embodiment, said transmembrane domain comprises a positively charged moiety, e.g., an amino acid residue comprising a positively charged moiety, e.g., side chain. In one embodiment, said transmembrane domain comprises a KIR-transmembrane domain.

In one embodiment, said KIR-CAR is an activating KIR-CAR. In one embodiment, said KIR-CAR comprises a KIR-transmembrane domain. In one embodiment, said KIR- CAR is an inhibitory KIR-CAR. In one embodiment, said KIR-CAR comprises a KIR-cytoplasmic domain. In one embodiment, said KIR-CAR comprises an extra-cellular antigen binding domain and a transmembrane domain, e.g., a transmembrane domain comprising a positively charged moiety, e.g., an amino acid residue comprising a positively charged moiety, e.g., side chain, or a KIR-transmembrane domain.

In one embodiment, a KIR-CAR described herein comprises an antigen binding domain comprising an scFv. In one embodiment, said antigen binding domain comprises a single VH domain, e.g., a camelid, shark, or lamprey single VH domain, or a single VH domain derived from a human or mouse sequence, or a non-antibody scaffold, e.g., a fibronectin, e.g., a fibronectin type III antibody-like molecule. In one embodiment, said antigen binding domain comprises a nanobody. In one embodiment, said antigen binding domain comprises a camelid VHH domain.

In one embodiment, the KIR-CAR is an activating KIR-CAR, and the extra-cellular antigen binding domain is an antigen binding domain described herein, e.g., in Table 4.

In one embodiment, a KIR-CAR described herein comprises an extracellular hinge domain. In one embodiment, the extracellular hinge domain is other than a KIR hinge domain, e.g., other than a KIR2DS2 hinge domain. In one embodiment, the extracellular hinge domain is derived from a natural molecule. In one embodiment, the extracellular hinge domain is derived from a natural molecule other than a KIR. In one embodiment, the extracellular hinge domain comprises a non-naturally occurring polypeptide sequence. In one embodiment, the extracellular hinge domain comprises the extracellular hinge from human CD8-alpha. In one embodiment, the extracellular hinge domain comprises a synthetic extracellular hinge. In one embodiment, the extracellular hinge domain is less than 50, 20, or 10 amino acids in length. In one embodiment, the extracellular hinge domain has fewer amino acids than a KIR2DS2 hinge domain.

In one embodiment, the KIR-CAR described herein is an actKIR-CAR. In one embodiment, said actKIR-CAR comprises a transmembrane domain comprising a positively charged moiety, e.g., an amino acid residue comprising a positively charged moiety, e.g., a positively charged side chain or an actKIR transmembrane domain. In one embodiment, said actKIR-CAR can interact with and promote signaling from an ITAM-containing polypeptide or adaptor molecule. In one embodiment, said actKIR-CAR can interact with and promote signaling from a DAP12 polypeptide. In one embodiment, said actKIR-CAR comprises a KIR D domain. In one embodiment, said actKIR-CAR comprises a KIR D1 domain. In one embodiment, said actKIR-CAR comprises a KIR D2 domain. In one embodiment, said actKIR-CAR said act KIR-CAR does not comprise a KIR D domain. In one embodiment, said actKIR-CAR comprises a KIR2DS2 transmembrane domain. In one embodiment, said actKIR-CAR further comprises a KIR2DS2 cytoplasmic domain. In one embodiment, said actKIR-CAR does not comprise a KIR D domain.

In one embodiment, the antigen binding domain of a KIR-CAR described herein binds an antigen present on a target cell, e.g., a cancer cell. In one embodiment, said antigen binding domain binds an antigen that is more highly expressed on a target cell, e.g., a cancer cell, than a non-target cell, e.g., a non-cancerous cell, e.g., a non cancerous cell of the same type as the target cell. In one embodiment, said antigen binding domain is binds an antigen described herein, e.g., a tumor antigen described herein. In one embodiment, the tumor antigen is expressed on a solid tumor, e.g., a solid tumor described herein, e.g., mesothelioma (e.g., malignant pleural mesothelioma), lung cancer (e.g., non-small cell lung cancer, small cell lung cancer, squamous cell lung cancer, or large cell lung cancer), pancreatic cancer (e.g., pancreatic ductal adenocarcinoma), ovarian cancer, colorectal cancer and bladder cancer or any combination thereof.

In one embodiment, the KIR-CAR described herein is an inhKIR-CAR. In one embodiment, the inhKIR-CAR comprises an inhKIR transmembrane domain. In one embodiment, the inhKIR-CAR inhKIR-CAR comprises an ITIM-containing cytoplasmic domain, e.g., an inhKIR cytoplasmic domain, e.g., a KIR2DL or KIR3DL cytoplasmic domain. In one embodiment, the inhKIR-CAR comprises a transmembrane other than a KIR transmembrane, e.g., a transmembrane domain from PD-1, CTLA4 or ITIM-containing receptors from ILT (CD85), Siglec, LMIR (CD300) and/or SLAM gene families of receptors. In one embodiment, the inhKIR-CAR comprises a cytoplasmic domain from an inhibitory receptor other than a KIR, e.g., from PD-1, CTLA4 or ITIM-containing receptors from ILT (CD85), Siglec, LMIR (CD300) and/or SLAM gene families of receptors. In one embodiment, the inhKIR-CAR comprises a transmembrane and cytoplasmic domain from an inhibitory receptor other than a KIR, e.g., transmembrane and cytoplasmic domain, independently, from e.g., PD-1, CTLA4 or ITIM-containing receptors from ILT (CD85), Siglec, LMIR (CD300) and/or SLAM gene families of receptors. In one embodiment, said cytoplasmic domain comprises an ITIM. In one embodiment, the inhKIR-CAR comprises a KIR D domain. In one embodiment, the inhKIR-CAR comprises a KIR D0 domain. In one embodiment, the inhKIR-CAR comprises a KIR D1 domain. In one embodiment, the inhKIR-CAR comprises a KIR D2 domain. In one embodiment, the inhKIR-CAR does not comprise a KIR D domain.

In one embodiment, the antigen binding domain of the inhKIR-CARs described herein binds an antigen not present on a target cell, e.g., a cancer cell. In one embodiment, said antigen binding domain binds an antigen that is more highly expressed on a non-target cell, e.g., a non-cancer cell, than a target cell, e.g., cancerous cell, e.g., a cancerous cell of the same type as the target cell. In one embodiment, said antigen binding domain binds desmoglein1/3 (DSG1/3). In an embodiment, an inhCAR, e.g., an inhTCAR or inhNKR-CAR, e.g., an inhKIR-CAR, and an actCAR, e.g., an actTCAR or actNKR-CAR, e.g., an actKIR-CAR, are provided in which the inhCAR comprises an antigen binding domain that targets desmoglein1/3 (DSG1/3) and the actCAR comprises an antigen binding domain that targets an antigen other than DSG1/3, e.g., EGFR. In an embodiment, this pair is used to treat an EGFR expressing cancer, e.g., an adenocarcinoma of the lung or colon. In an embodiment the cancer cells express less DSG1/3 than non-cancer cells. In an embodiment this combination can minimize CAR-mediated attack of skin cells or squamous cells of the GI track (i.e. oral mucosa). In one embodiment, said antigen binding domain binds an ephrin receptor or a claudin.

In another aspect, the invention features a nucleic acid, e.g., a purified or non-naturally occurring, nucleic acid, e.g., a nucleic acid comprising a DNA, or RNA, sequence, e.g., a mRNA, comprising (a) a sequence that encodes a KIR-CAR, e.g., a first KIR-CAR described herein. In one embodiment, said KIR-CAR, e.g., said first KIR-CAR, is an actKIR-CAR, e.g., an actKIR-CAR described herein. In one embodiment, the nucleic acid encodes an actKIR-CAR, and the encoded extra-cellular antigen binding domain is an antigen binding domain described herein, e.g., in Table 4. In one embodiment, said KIR-CAR, e.g., said first KIR-CAR, is an inhKIR-CAR, e.g., an inhKIR-CAR described herein.

In one embodiment, said nucleic acid comprises a DNA sequence. In one embodiment, said nucleic acid comprises a RNA sequence, e.g., a mRNA sequence.

In an embodiment, said nucleic acid comprises sequence that encodes a KIR-CAR, e.g., an actKIR-CAR, and sequence that encodes an inhibitory molecule comprising: an inhKIR cytoplasmic domain; a transmembrane domain, e.g., a KIR transmembrane domain; and an inhibitor cytoplasmic domain, e.g., an ITIM domain, e.g., an inhKIR ITIM domain. In an embodiment, the inhibitory molecule is a naturally occurring inhKIR, or a sequence sharing at least 50, 60, 70, 80, 85, 90, 95, or 99% homology with, or that differs by no more than 1, 2, 3, 4, 5, 6, 7, 8, 9, 10, 15, or 20 residues from, a naturally occurring inhKIR.

In an embodiment, said nucleic acid comprises sequence that encodes a KIR-CAR, e.g., an actKIR-CAR, and sequence that encodes an inhibitory molecule comprising: a SLAM family cytoplasmic domain; a transmembrane domain, e.g., a SLAM family transmembrane domain; and an inhibitor cytoplasmic domain, e.g., a SLAM family domain, e.g., an SLAM family ITIM domain. In an embodiment, the inhibitory molecule is a naturally occurring SLAM family member, or a sequence sharing at least 50, 60, 70, 80, 85, 90, 95, or 99% homology with, or that differs by no more than 1, 2, 3, 4, 5, 6, 7, 8, 9, 10, 15, or 20 residues from, a naturally occurring SLAM family member.

In one embodiment, said nucleic acid described herein further comprises (b) a sequence that encodes a second KIR-CAR described herein, e.g., a second KIR-CAR that is different from said first KIR-CAR. In one embodiment, (a) and (b) are disposed on the same nucleic acid molecule, e.g., the same vector, e.g., the same viral vector, e.g., a lenti-viral vector. In one embodiment, one of (a) and (b) is disposed on a first nucleic acid molecule, e.g., a first vector, e.g., a viral vector, e.g., a lenti-viral vector, and the other is disposed on a second nucleic acid molecule, e.g., a second vector, e.g., a viral vector, e.g., a lenti-viral vector. In one embodiment, said first KIR-CAR and said second KIR-CAR is an actKIR-CAR. In an embodiment, engagement of either act KIR-CAR alone is insufficient to trigger substantial levels of activation. In an embodiment, engagement of both the first and second actKIR-CAR gives an additive, or synergistic, level of activation. In one embodiment, said first KIR-CAR and said second KIR-CAR is an inhKIR-CAR. In one embodiment, one of said first KIR-CAR and said second KIR-CAR is an actKIR-CAR and the other is an inhKIR-CAR. In one embodiment, said actKIR-CAR is an actKIR-CAR described herein. In one embodiment, said inhKIR-CAR is an inhKIR-CAR described herein. In one embodiment, the nucleic acid described herein comprises an actKIR-CAR described herein and an inhKIR-CAR described herein.

In an embodiment the nucleic further comprises (c) sequence that encodes an intracellular signaling domain, e.g., an adaptor molecule, which can produce an activating signal. In one embodiment, said intracellular signaling domain comprises an ITAM motif. In one embodiment, said sequence encodes a DAP 12 polypeptide comprising a DAP 12 intracellular signaling domain. In one embodiment, said DAP 12 polypeptide further comprises a transmembrane domain. In one embodiment, said DAP 12 polypeptide further comprises an extracellular domain. In one embodiment, each of (a), (b), and (c) are present on the same nucleic acid molecule, e.g., a vector, e.g., a viral vector, e.g., a lenti-viral vector. In one embodiment, one of (a), (b), and (c) is encoded on a first nucleic acid molecule, e.g., a vector, e.g., a viral vector, e.g., a lenti-viral vector and a second and third of (a), (b), and (c) is encoded on a second nucleic acid molecule, e.g., a vector, e.g., a viral vector, e.g., a lenti-viral vector. In one embodiment (a) is present on a first nucleic acid molecule, e.g., a vector, e.g., a viral vector, e.g., a lenti-viral vector, and (b) and (c) are present on a second nucleic acid molecule, e.g., a vector, e.g., a viral vector, e.g., a lenti-viral vector. In another embodiment, (b) is present on a first nucleic acid molecule, e.g., a vector, e.g., a viral vector, e.g., a lenti-viral vector, and (a) and (c) are present on a second nucleic acid molecule, e.g., a vector, e.g., a viral vector, e.g., a lenti-viral vector. In one embodiment, (c) is present on a first nucleic acid molecule, e.g., a vector, e.g., a viral vector, e.g., a lenti-viral vector, and (b) and (a) are present on a second nucleic acid molecule, e.g., a vector, e.g., a viral vector, e.g., a lenti-viral vector. In one embodiment, each of (a), (b), and (c) are present on different nucleic acid molecules, e.g., different vectors, e.g., viral vectors, e.g., a lenti-viral vectors.

In an embodiment, (i) the antigen binding domain of one of said first KIR-CAR and said second KIR-CAR does not comprise a light chain variable domain and a heavy chain variable domain, (ii) the antigen binding domain of one of said first KIR-CAR and said second KIR-CAR is an scFv, and the other is other is other than an scFv, (iii) when present on the surface of a cell, the antigen binding domains of said first KIR-CAR and said second KIR-CAR, associate with one another less than if both were scFv antigen binding domains, (iv) wherein, when present on the surface of a cell, binding of the antigen binding domain of said first KIR-CAR to its cognate antigen is not substantially reduced by the presence of said second KIR-CAR, (v) the antigen binding domain of one of said first KIR-CAR and said second KIR-CAR, comprises a single VH domain, e.g., a camelid, shark, or lamprey single VH domain, or a single VH domain derived from a human or mouse sequence, or a non-antibody scaffold, e.g., a fibronectin, e.g., a fibronectin type III antibody-like molecule, (vi) the antigen binding domain of one of said first KIR-CAR and said second KIR-CAR, is an scFv, and the other comprises a single VH domain, e.g., a camelid, shark, or lamprey single VH domain, or a single VH domain derived from a human or mouse sequence or a non-antibody scaffold, e.g., a fibronectin, e.g., a fibronectin type III antibody-like molecule, (vii) the antigen binding domain of one of said first KIR-CAR and said second KIR-CAR, is an scFv, and the other comprises a nanobody, or (viii) the antigen binding domain of one of said first KIR-CAR and said second KIR-CAR, is an scFv, and the other comprises a camelid VHH domain.

In one embodiment, the antigen binding domain of one of said first KIR-CAR and said second KIR-CAR does not comprise a light chain variable domain and a heavy chain variable domain. In one embodiment, the antigen binding domain of one of said first KIR-CAR and said second KIR-CAR is an scFv, and the other is other than an scFv. In one embodiment, when present on the surface of a cell, the antigen binding domains of said first KIR-CAR and said second KIR-CAR, associate with one another less than if both were scFv antigen binding domains. In one embodiment, when present on the surface of a cell, binding of the antigen binding domain of said first KIR-CAR to its cognate antigen is not substantially reduced by the presence of said second KIR-CAR. In one embodiment, the antigen binding domain of one of said first KIR-CAR and said second KIR-CAR, comprises a single VH domain, e.g., a camelid, shark, or lamprey single VH domain, or a single VH domain derived from a human or mouse sequence or a non-antibody scaffold, e.g., a fibronectin, e.g., a fibronectin type III antibody-like molecule. In one embodiment, the antigen binding domain of one of said first KIR-CAR and said second KIR-CAR, is an scFv, and the other comprises a single VH domain, e.g., a camelid, shark, or lamprey single VH domain, or a single VH domain derived from a human or mouse sequence or a non-antibody scaffold, e.g., a fibronectin, e.g., a fibronectin type III antibody-like molecule. In one embodiment, the antigen binding domain of one of said first KIR-CAR and said second KIR-CAR, is an scFv, and the other comprises a nanobody. In one embodiment, the antigen binding domain of one of said first KIR-CAR and said second KIR-CAR, is an scFv, and the other comprises a camelid VHH domain.

In an embodiment, the nucleic acid comprises a sequence that encodes a TCAR. In one embodiment, said TCAR comprises an antigen binding domain and an activating cytoplasmic domain from the T cell receptor complex with CD3 e.g. CD3 zeta chain, CD3 epsilon chain, CD3 gamma chain, CD3 delta chain. In one embodiment, said TCAR comprises a costimulatory domain from costimulatory receptor e.g. CD28, CD137, CD27, ICOS or OX40.

In an embodiment (i) the antigen binding domain of one of said KIR-CAR said TCAR does not comprise a light chain variable domain and a heavy chain variable domain, (ii) the antigen binding domain of one of said KIR-CAR and said TCAR is an scFv, and the other is other than an scFv, (iii) when present on the surface of a cell, the antigen binding domains of said KIR-CAR and said TCAR, associate with one another less than if both were scFv antigen binding domains, (iv) when present on the surface of a cell, binding of the antigen binding domain of said KIR-CAR to its cognate antigen is not substantially reduced by the presence of said second TCAR, (v) the antigen binding domain of one of said KIR-CAR and said TCAR, comprises a single VH domain, e.g., a camelid, shark, or lamprey single VH domain, or a single VH domain derived from a human or mouse sequence or a non-antibody scaffold, e.g., a fibronectin, e.g., a fibronectin type III antibody-like molecule, (vi) the antigen binding domain of one of said KIR-CAR and said TCAR, is an scFv, and the other comprises a single VH domain, e.g., a camelid, shark, or lamprey single VH domain, or a single VH domain derived from a human or mouse sequence or a non-antibody scaffold, e.g., a fibronectin, e.g., a fibronectin type III antibody-like molecule, (vii) the antigen binding domain of one of said KIR-CAR and said TCAR, is an scFv, and the other comprises a nanobody, or (viii) wherein, the antigen binding domain of one of said KIR-CAR and said TCAR, is an scFv, and the other comprises a camelid VHH domain. In one embodiment, the antigen binding domain of one of said KIR-CAR and said TCAR does not comprise a light chain variable domain and a heavy chain variable domain.

In one embodiment, the antigen-binding domain of one of said KIR-CAR and said TCAR is an scFv, and the other is other than an scFv. In one embodiment, when present on the surface of a cell, the antigen binding domains of said KIR-CAR and said TCAR, associate with one another less than if both were scFv antigen binding domains. In one embodiment, when present on the surface of a cell, binding of the antigen binding domain of said KIR-CAR to its cognate antigen is not substantially reduced by the presence of said second TCAR. In one embodiment, the antigen binding domain of one of said KIR-CAR said TCAR, comprises a single VH domain, e.g., a camelid, shark, or lamprey single VH domain, or a single VH domain derived from a human or mouse sequence or a non-antibody scaffold, e.g., a fibronectin, e.g., a fibronectin type III antibody-like molecule. In one embodiment, the antigen binding domain of one of said KIR-CAR and said TCAR, is an scFv, and the other comprises a single VH domain, e.g., a camelid, shark, or lamprey single VH domain, or a single VH domain derived from a human or mouse sequence or a non-antibody scaffold, e.g., a fibronectin, e.g., a fibronectin type III antibody-like molecule. In one embodiment, the antigen binding domain of one of said KIR-CAR and said TCAR, is an scFv, and the other comprises a nanobody. In one embodiment, the antigen binding domain of one of said KIR-CAR and said TCAR, is an scFv, and the other comprises a camelid VHH domain.

In one embodiment, the antigen binding domain of one of said KIR-CAR and said TCAR binds to mesothelin and the other binds a different antigen binding domain, e.g., to the same target (mesothelin) or a different target (e.g., a target other than mesothelin on stroma cells, e.g., FAP; a target other than mesothelin on prostate cancer cells, e.g., androgen receptor, OR51E2, PSMA, PSCA, PDGRF-β, TARP, GloboH, MAD-CT-1, or MAD-CT-2; a target other than mesothelin on ovarian cancer cells, e.g., Tn, PRSS21, CD171, Lewis Y, folate receptor α, claudin6, GloboH, or sperm protein 17).

In another aspect, the invention features a cytotoxic cell, e.g., a naturally or non-naturally occurring T cell, NK cell or cytotoxic T cell or cell of an NK cell line, e.g., NK92, comprising (a) a first KIR-CAR described herein. In one embodiment, said cytotoxic cell is T cell. In one embodiment, said cytotoxic cell is an NK cell. In one embodiment, said cytotoxic cell is from an NK cell line, e.g., an NK92 cell. In one embodiment, said first KIR-CAR is an actKIR-CAR described herein. In one embodiment, said first KIR-CAR is an inhKIR-CAR described herein.

In an embodiment, said cytotoxic cell comprises a KIR-CAR, e.g., an actKIR-CAR, and an inhibitory molecule comprising: an inhKIR cytoplasmic domain; a transmembrane domain, e.g., a KIR transmembrane domain; and an inhibitor cytoplasmic domain, e.g., an ITIM domain, e.g., an inhKIR ITIM domain. In an embodiment, the inhibitory molecule is a naturally occurring inhKIR, or a sequence sharing at least 50, 60, 70, 80, 85, 90, 95, or 99% homology with, or that differs by no more than 1, 2, 3, 4, 5, 6, 7, 8, 9, 10, 15, or 20 residues from, a naturally occurring inhKIR.

In an embodiment, said cytotoxic cell comprises a KIR-CAR, e.g., an actKIR-CAR, and an inhibitory molecule comprising: a SLAM family cytoplasmic domain; a transmembrane domain, e.g., a SLAM family transmembrane domain; and an inhibitor cytoplasmic domain, e.g., a SLAM family domain, e.g., an SLAM family ITIM domain. In an embodiment the inhibitory molecule is a naturally occurring SLAM family member, or a sequence sharing at least 50, 60, 70, 80, 85, 90, 95, or 99% homology with, or that differs by no more than 1, 2, 3, 4, 5, 6, 7, 8, 9, 10, 15, or 20 residues from, a naturally occurring SLAM family member.

In one embodiment, the cytotoxic cell further comprises (b) a second KIR-CAR described herein, e.g., a second KIR-CAR that is different from said first KIR-CAR. In one embodiment, one of said KIR-CAR and said second KIR-CAR is an actKIR-CAR and the other is an inhKIR-CAR. In one embodiment, said actKIR-CAR is an actKIR-CAR described herein. In one embodiment, one of said inhKIR-CAR is an inhKIR-CAR described herein. In one embodiment, the cytotoxic cell described herein comprises actKIR-CAR described herein and an inhKIR-CAR described herein.

In an embodiment, the cytotoxic cell further comprises an intracellular signaling domain, e.g., an adaptor molecule, which can produce an activating signal, e.g., which is exogenous to said cell, which can produce an activating signal. In one embodiment, said intracellular signaling domain comprises an ITAM motif. In one embodiment, said intracellular signaling domain comprises a DAP 12 polypeptide comprising DAP 12 intracellular signaling domain. In one embodiment, said DAP 12 polypeptide further comprises a transmembrane domain. In one embodiment, said DAP 12 polypeptide further comprises an extracellular domain.

In an embodiment a cytotoxic cell comprises a first and second KIR-CAR described herein wherein (i) the antigen binding domain of one of said first KIR-CAR and said second KIR-CAR does not comprise a light chain variable domain and a heavy chain variable domain, (ii) the antigen binding domain of one of said first KIR-CAR and said second KIR-CAR is an scFv, and the other is other than an scFv, (iii) when present on the surface of a cell, the antigen binding domains of said first KIR-CAR and said second KIR-CAR, associate with one another less than if both were scFv antigen binding domains, (iv) when present on the surface of a cell, binding of the antigen binding domain of said first KIR-CAR to its cognate antigen is not substantially reduced by the presence of said second KIR-CAR, (v) the antigen binding domain of one of said first KIR-CAR and said second KIR-CAR, comprises a single VH domain, e.g., a camelid, shark, or lamprey single VH domain, or a single VH domain derived from a human or mouse sequence or a non-antibody scaffold, e.g., a fibronectin, e.g., a fibronectin type III antibody-like molecule, (vi) the antigen binding domain of one of said first KIR-CAR and said second KIR-CAR, comprises an scFv, and the other comprises a single VH domain, e.g., a camelid, shark, or lamprey single VH domain, or a single VH domain derived from a human or mouse sequence or a non-antibody scaffold, e.g., a fibronectin, e.g., a fibronectin type III antibody-like molecule, (vii) wherein, the antigen binding domain of one of said first KIR-CAR and said second KIR-CAR, comprises an scFv, and the other comprises a nanobody, or (viii) the antigen binding domain of one of said first KIR-CAR and said second KIR-CAR, comprises an scFv, and the other comprises a camelid VHH domain.

In one embodiment, the antigen binding domain of one of said first KIR-CAR and said second KIR-CAR does not comprise a light chain variable domain and a heavy chain variable domain. In one embodiment, the antigen-binding domain of one of said first KIR-CAR and said second KIR-CAR is an scFv, and the other is other than an scFv. In one embodiment, when present on the surface of a cell, the antigen binding domains of said first KIR-CAR and said second KIR-CAR, associate with one another less than if both were scFv antigen binding domains. In one embodiment, when present on the surface of a cell, binding of the antigen binding domain of said first KIR-CAR to its cognate antigen is not substantially reduced by the presence of said second KIR-CAR. In one embodiment, the antigen binding domain of one of said first KIR-CAR and said second KIR-CAR, comprises a single VH domain, e.g., a camelid, shark, or lamprey single VH domain, or a single VH domain derived from a human or mouse sequence or a non-antibody scaffold, e.g., a fibronectin, e.g., a fibronectin type III antibody-like molecule. In one embodiment, the antigen binding domain of one of said first KIR-CAR and said second KIR-CAR, comprises an scFv, and the other comprises a single VH domain, e.g., a camelid, shark, or lamprey single VH domain, or a single VH domain derived from a human or mouse sequence or a non-antibody scaffold, e.g., a fibronectin, e.g., a fibronectin type III antibody-like molecule. In one embodiment, the antigen-binding domain of one of said first KIR-CAR and said second KIR-CAR, comprises an scFv, and the other comprises a nanobody. In one embodiment, the antigen-binding domain of one of said first KIR-CAR and said second KIR-CAR, comprises an scFv, and the other comprises a camelid VHH domain.

In one embodiment, the antigen binding domain of one of said first KIR-CAR and said second KIR-CAR binds to mesothelin and the other binds a different antigen binding domain, e.g., to the same target (mesothelin) or a different target (e.g., a target other than mesothelin on stroma cells, e.g., FAP; a target other than mesothelin on prostate cancer cells, e.g., androgen receptor, OR51E2, PSMA, PSCA, PDGRF-β, TARP, GloboH, MAD-CT-1, or MAD-CT-2; a target other than mesothelin on ovarian cancer cells, e.g., Tn, PRSS21, CD171, Lewis Y, folate receptor α, claudin6, GloboH, or sperm protein 17).

In an embodiment, a cytotoxic cell comprises KIR-CARs as described herein and further comprises a TCAR. In one embodiment, said TCAR comprises an antigen binding domain and a primary stimulation domain. In one embodiment, said TCAR comprises a costimulation domain.

In an embodiment, the cytotoxic cell, e.g., a naturally or non-naturally occurring T cell, NK cell or cytotoxic T cell or NK cell line, e.g., an NK92 cell, comprises a nucleic acid as described herein; or a KIR-CAR encoded by a nucleic acid described herein. In one embodiment, said cytotoxic cell is T cell. In one embodiment, said cytotoxic cell is an NK cell. In one embodiment, said cytotoxic cell is from an NK cell line, e.g., NK92.

In another aspect, the invention features methods of making a cell described herein comprising, introducing into a cytotoxic cell, a nucleic acid described herein into said cell. In one embodiment, said method comprises forming in a cytotoxic cell, a KIR-CAR described herein.

In another aspect, the invention features methods of treating a subject, e.g., a method of providing an anti-tumor immunity in a mammal, comprising administering to the mammal an effective amount of a cell described herein. In one embodiment, said cell is autologous. In one embodiment, said cell is allogenic. In one embodiment, the cell is T cell, e.g., an autologous T cell. In one embodiment, the cell is an allogeneic T cell. In one embodiment, the cell is an NK cell, e.g., an autologous NK cell. In one embodiment, the cell is an allogeneic NK cell. In one embodiment, the cell is cell from an NK cell line, e.g., NK92. In one embodiment, said mammal is a human. In one embodiment, the method further comprises evaluating said mammal, e.g., human, for a side effect of said treatment. In one embodiment, said side effect comprises acute respiratory distress syndrome, febrile neutropenia, hypotension, encephalopathy, hepatic transaminitis, seizure, or macrophage activation syndrome. In one embodiment, the method further comprises treating said human having a side effect with an agent described herein, e.g., anti-cytokine agent, e.g., a tumor necrosis factor antagonist, e.g., a TNF-Ig fusion, e.g., etanercept, an IL-6 antagonist, e.g., an IL-6 receptor antagonist, e.g., an anti-IL6 receptor antibody, e.g., tocilizumab, or a corticosteroid. In one embodiment, treating comprises administering an anti-IL6 receptor antibody to said human.

In one embodiment, the disease associated with expression of a tumor antigen is cancer, e.g., a cancer described herein. In one embodiment, the cancer is a solid tumor, e.g., a solid tumor described herein, e.g., mesothelioma (e.g., malignant pleural mesothelioma), lung cancer (e.g., non-small cell lung cancer, small cell lung cancer, squamous cell lung cancer, or large cell lung cancer), pancreatic cancer (e.g., pancreatic ductal adenocarcinoma), ovarian cancer, colorectal cancer and bladder cancer or any combination thereof. In one embodiment, the disease is pancreatic cancer, e.g., metastatic pancreatic ductal adenocarcinoma (PDA), e.g., in a subject who has progressed on at least one prior standard therapy. In one embodiment, the disease is mesothelioma (e.g., malignant pleural mesothelioma), e.g., in a subject who has progressed on at least one prior standard therapy. In one embodiment, the disease is ovarian cancer, e.g., serous epithelial ovarian cancer, e.g., in a subject who has progressed after at least one prior regimen of standard therapy.

In one embodiment, the method comprises treating a mammal, e.g., a human, having a disease associated with expression of mesothelin or CD19. In one embodiment, the method comprises treating a mammal, e.g., a human, having a disorder associated with unwanted cell proliferation, e.g., cancer. In one embodiment, said disorder is pancreatic carcinoma, mesothelioma, lung carcinoma, ovarian carcinoma, leukemia or lymphoma.

In another aspect, the invention features a purified, or non-naturally occurring, NCR-CAR, e.g., an activating NCR-CAR, comprising an extra-cellular antigen binding domain, a transmembrane domain, e.g., a transmembrane domain comprising a positively charged moiety, e.g., an amino acid residue comprising a positively charged moiety, e.g., a positively charged side chain or an NCR transmembrane domain, and a cytoplasmic domain, e.g., a NCR cytoplasmic domain.

In one embodiment, said NCR-CAR comprises an a transmembrane domain comprising a positively charged moiety, e.g., an amino acid residue comprising a positively charged moiety, e.g., a positively charged side chain, e.g., NCR transmembrane domain, e.g., a NKp30, NKp44, or NKp46 cytoplasmic domain. In one embodiment, said NCR-CAR comprises a cytoplasmic domain which can interact with an adaptor molecule or intracellular signaling molecule comprising, e.g., a DAP12, FcRγ or CD3ζ cytoplasmic domain. In one embodiment, said NCR-CAR, e.g., a NKp30-CAR, comprises a transmembrane domain which can interact with an adaptor molecule or intracellular signaling molecule, e.g., DAP12. In one embodiment, said NCR-CAR comprises a NKp46-CAR. In one embodiment, said NKp46-CAR, comprises a transmembrane domain comprising a positively charged moiety, e.g., an amino acid residue comprising a positively charged moiety, e.g., a positively charged side chain or, e.g., an NCR transmembrane domain, which can interact with an adaptor molecule or intracellular signaling molecule, e.g., one having a FcRγ or CD3ζ cytoplasmic domain. In one embodiment, said NCR-CAR described herein further comprises a hinge domain disposed between said transmembrane domain and said an extra-cellular antigen binding domain.

In one embodiment, the NCR-CAR is an activating NCR-CAR, and the extra-cellular antigen binding domain is an antigen binding domain described herein, e.g., in Table 4.

In another aspect, the invention features a nucleic acid, e.g., a purified or non-naturally occurring, nucleic acid, e.g., a nucleic acid comprising a DNA, or RNA, sequence, e.g., a mRNA, comprising a sequence that encodes a NCR-CAR described herein. In one embodiment, the nucleic acid comprises a sequence that encodes a NKp30-CAR and optionally, an adaptor molecule or intracellular signaling molecule, e.g., DAP12. In one embodiment, said NCR-CAR, e.g., NKp46-CAR, comprises a transmembrane domain comprising a positively charged moiety, e.g., an amino acid residue comprising a positively charged moiety, e.g., a positively charged side chain or an NCR transmembrane domain which can interact with an adaptor molecule or intracellular signaling molecule, e.g., a FcRγ or CD3ζ molecule. In one embodiment, the nucleic acid further comprises sequence encoding an adaptor molecule or intracellular signaling molecule, which e.g., comprises a DAP12, FcRγ or CD3ζ.

In one embodiment, the nucleic acid encodes an actNCR-CAR, and the encoded extra-cellular antigen binding domain is an antigen binding domain described herein, e.g., in Table 4.

In another aspect, the invention features a cytotoxic cell, e.g., a naturally or non-naturally occurring T cell, NK cell or cytotoxic T cell or NK cell line comprising a NCR-CAR described herein. In one embodiment, the cytotoxic cell further comprises an adaptor molecule or intracellular signaling molecule, which e.g., comprises a DAP12, FcRγ or CD3ζ cytoplasmic domain. In one embodiment, the cytotoxic cell comprises a NKp30-CAR and optionally, an adaptor molecule or intracellular signaling molecule, e.g., DAP12. In one embodiment, said NKp46-CAR comprises a transmembrane domain which can interact with an adaptor molecule or intracellular signaling molecule, e.g., a FcRγ or CD3ζ molecule.

In another aspect, the invention features a method of making a cell described herein comprising, introducing into a cytotoxic cell, a nucleic acid comprising a sequence that encodes a NCR-CAR described herein. In one embodiment, the method comprises forming in a cytotoxic cell, a NCR-CAR described herein.

In another aspect, the invention features a method of treating a subject, e.g., a method of providing an anti-tumor immunity in a mammal, comprising administering to the mammal an effective amount of a cell described herein, e.g., a cell of claim described herein comprising NCR-CAR described herein.

In another aspect, the invention features a method of treating a subject having a disease associated with expression of tumor antigen, e.g., a tumor antigen described herein (e.g., a proliferative disease, a precancerous condition, and a noncancer related indication associated with the expression of a tumor antigen) comprising administering to the subject an effective amount of a cell comprising a NCR-CAR, e.g., as described herein. In one embodiment, the NCR-CAR is an activating NCR-CAR and the extra-cellular antigen binding domain is an antigen binding domain described herein, e.g., in Table 4.

In one embodiment, the disease associated with expression of a tumor antigen is cancer, e.g., a cancer described herein. In one embodiment, the cancer is a solid tumor, e.g., a solid tumor described herein, e.g., mesothelioma (e.g., malignant pleural mesothelioma), lung cancer (e.g., non-small cell lung cancer, small cell lung cancer, squamous cell lung cancer, or large cell lung cancer), pancreatic cancer (e.g., pancreatic ductal adenocarcinoma), ovarian cancer, colorectal cancer and bladder cancer or any combination thereof. In one embodiment, the disease is pancreatic cancer, e.g., metastatic pancreatic ductal adenocarcinoma (PDA), e.g., in a subject who has progressed on at least one prior standard therapy. In one embodiment, the disease is mesothelioma (e.g., malignant pleural mesothelioma), e.g., in a subject who has progressed on at least one prior standard therapy. In one embodiment, the disease is ovarian cancer, e.g., serous epithelial ovarian cancer, e.g., in a subject who has progressed after at least one prior regimen of standard therapy.

In another aspect, the invention features a purified, or non-naturally occurring, SLAMF-CAR, e.g., an inhibitory SLAMF-CAR, comprising an extra-cellular antigen binding domain, a transmembrane domain, e.g., a transmembrane domain comprising a positively charged moiety, e.g., an amino acid residue comprising a positively charged moiety, e.g., a positively charged side chain, e.g., a SLAMF transmembrane domain, and a SLAMF cytoplasmic domain. In one embodiment, said SLAMF-CAR comprises a SLAMF, CD48, CD229, 2B4, CD84, NTB-A, CRACC, BLAME, or CD2F-10 cytoplasmic domain. In one embodiment, said SLAMF-CAR further comprises a hinge domain, disposed between said transmembrane domain and said an extra-cellular antigen binding domain.

In another aspect, the invention features a nucleic acid, e.g., a purified or non-naturally occurring, nucleic acid, e.g., a nucleic acid comprising a DNA, or RNA, sequence, e.g., a mRNA, comprising a sequence that encodes a SLAMF-CAR described herein.

In another aspect, the invention features a cytotoxic cell, e.g., a naturally or non-naturally occurring T cell, NK cell or cytotoxic T cell or NK cell line comprising a SLAMF-CAR described herein.

In another aspect, the invention features a method of making a cytotoxic cell comprising a SLAMF-CAR described herein, comprising, introducing into a cytotoxic cell a nucleic acid comprising a sequence that encodes a SLAMF-CAR described herein. In one embodiment, the method comprises forming in a cytotoxic cell, a SLAMF-CAR described herein.

In another aspect, the invention features a method of treating a subject, e.g., a method of providing an anti-tumor immunity in a mammal, comprising administering to the mammal an effective amount of a cell comprising a SLAMF-CAR described herein.

In another aspect, the invention features a purified, or non-naturally occurring, FcR-CAR, e.g., CD16-CAR, e.g., an activating CD16-CAR or a CD64-CAR, e.g., an activating CD64-CAR, comprising an extra-cellular antigen binding domain, a transmembrane domain, and a CD16 or CD64 cytoplasmic domain. In one embodiment, said FcR-CAR is a CD16-CAR. In one embodiment, said FcR-CAR is a CD64-CAR. In one embodiment, said FcR-CAR can interact with an adaptor molecule or intracellular signaling molecule, e.g., a FcRγ or CD3ζ domain, e.g., via a transmembrane domain, e.g., a transmembrane domain comprising a positively charged moiety, e.g., an amino acid residue comprising a positively charged moiety, e.g., a positively charged side chain or e.g., a CD16 or CD64 transmembrane domain. In one embodiment, said FcR-CAR further comprises a hinge domain, disposed between said transmembrane domain and said an extra-cellular antigen binding domain.

In another aspect, the invention features a purified or non-naturally occurring, nucleic acid, e.g., a nucleic acid comprising a DNA, or RNA, sequence, e.g., a mRNA comprising a sequence that encodes a FcR-CAR described herein. In one embodiment, the nucleic acid further comprises an adaptor molecule or intracellular signaling molecule comprising a cytoplasmic activation domain, e.g., FcRγ or CD3ζ cytoplasmic domain. In one embodiment, said FcR-CAR and said cytoplasmic activation domain are disposed on separated nucleic acid molecules, e.g., separate vectors, e.g., separate viral vectors, e.g., separate lenti-viral vectors.

In another aspect, the invention features a cytotoxic cell, e.g., a naturally or non-naturally occurring T cell, NK cell or cytotoxic T cell or NK cell line comprising a FcR-CAR described herein. In one embodiment, the cytotoxic cell further comprises a cytoplasmic activation domain, e.g., FcRγ or CD3ζ cytoplasmic domain.

In another aspect, the invention features a method of making a cell comprising a FcR-CAR described herein, comprising, introducing into a cytotoxic cell, a nucleic acid comprising a sequence that encodes a FcR-CAR described herein. In one embodiment, the method comprises forming in a cytotoxic cell, a FcR-CAR described herein.

In another aspect, the invention features a method of treating a subject, e.g., a method of providing an anti-tumor immunity in a mammal, comprising administering to the mammal an effective amount of a cell comprising a FcR-CAR described herein.

In another aspect, the invention features purified, or non-naturally occurring, Ly49-CAR comprising an extra-cellular antigen binding domain, and a transmembrane domain, e.g., a Ly49-transmembrane domain, or a cytoplasmic domain, e.g., an ITIM-containing cytoplasmic domain, e.g., a Ly49-cytoplasmic domain. In one embodiment, the Ly49-CAR comprises a transmembrane domain and a Ly49-cytoplasmic domain. In one embodiment, said Ly49-CAR is an activating Ly49-CAR, e.g., Ly49D or Ly49H. In one embodiment, said Ly49-CAR comprises a positively charged transmembrane domain, e.g., a positively charged Ly49 transmembrane domain. In one embodiment, said Ly49-CAR can interact with an ITAM-containing cytoplasmic domain, e.g., DAP 12. In one embodiment, said Ly49-CAR comprises a Ly49-transmembrane domain. In one embodiment, said KIR-CAR is an inhibitory Ly49-CAR, e.g., Ly49A or Ly49C. In one embodiment, said Ly49-CAR comprises an ITIM-containing cytoplasmic domain, e.g., a Ly49-cytoplasmic domain. In one embodiment, said Ly49-CAR comprises a Ly49-transmembrane domain or a Ly49-cytoplasmic domain selected, independently from Ly49A-Ly49W. In one embodiment, said Ly49-CAR further comprises a hinge domain, disposed between said transmembrane domain and said an extra-cellular antigen binding domain.

In another aspect, the invention features a nucleic acid, e.g., a purified or non-naturally occurring, nucleic acid, e.g., a nucleic acid comprising a DNA, or RNA, sequence, e.g., a mRNA, comprising a sequence that encodes a Ly49-CAR described herein. In one embodiment, the nucleic acid further comprises a cytoplasmic activation domain, e.g., DAP12 cytoplasmic domain. In one embodiment, said Ly49-CAR and said cytoplasmic activation domain are disposed on separate nucleic acid molecules, e.g., separate vectors, e.g., separate viral vectors, e.g., separate lenti-viral vectors.

In another aspect, the invention features a cytotoxic cell, e.g., a naturally or non-naturally occurring T cell, NK cell or cytotoxic T cell or NK cell line comprising a Ly49-CAR described herein. In one embodiment, the cytotoxic cell further comprises a cytoplasmic activation domain, e.g., DAP12 cytoplasmic domain.

In another aspect, the invention features a method of making a cell comprising a Ly49-CAR described herein, comprising, introducing into a cytotoxic cell, a nucleic acid comprising a sequence that encodes a Ly49-CAR described herein into said cell.

In another aspect, the invention features a method of making a cell comprising a Ly49-CAR described herein, comprising, forming in a cytotoxic cell, a Ly49-CAR described herein.

In another aspect, the invention features a method of treating a subject, e.g., a method of providing an anti-tumor immunity in a mammal, comprising administering to the mammal an effective amount of a cell described herein, e.g., a cell comprising a Ly49-CAR described herein.

In another aspect, the invention features a cell comprising, e.g., a cytotoxic cell, comprising a first non-naturally occurring chimeric membrane embedded receptor comprising an antigen binding domain and a second non-naturally occurring chimeric membrane embedded receptor comprising an antigen binding domain wherein, (i) the antigen binding domain of one of said first and said second non-naturally occurring chimeric membrane embedded receptor does not comprise a light chain variable domain and a heavy chain variable domain, (ii) the antigen binding domain of one of said first and said second non-naturally occurring chimeric membrane embedded receptor comprises an scFv, and the other is other than an scFv, (iii) when present on the surface of a cell, the antigen binding domains of said first and said second non-naturally occurring chimeric membrane embedded receptor, associate with one another less than if both were scFv antigen binding domains, (iv) when present on the surface of a cell, binding of the antigen binding domain of said first non-naturally occurring chimeric membrane embedded receptor to its cognate antigen is not substantially reduced by the presence of said second non-naturally occurring chimeric membrane embedded receptor, (v) the antigen binding domain of one of said first and said second non-naturally occurring chimeric membrane embedded receptor, comprises a single VH domain, e.g., a camelid, shark, or lamprey single VH domain, or a single VH domain derived from a human or mouse sequence or a non-antibody scaffold, e.g., a fibronectin, e.g., a fibronectin type III antibody-like molecule, (vi) the antigen binding domain of one of said first said second non-naturally occurring chimeric membrane embedded receptor, comprises an scFv, and the other comprises a single VH domain, e.g., a camelid, shark, or lamprey single VH domain, or a single VH domain derived from a human or mouse sequence or a non-antibody scaffold, e.g., a fibronectin, e.g., a fibronectin type III antibody-like molecule, (vii) the antigen binding domain of one of said first and said second non-naturally occurring chimeric membrane embedded receptor, comprises an scFv, and the other comprises a nanobody, and (viii) the antigen binding domain of one of said first and said second non-naturally occurring chimeric membrane embedded receptor, comprises an scFv, and the other comprises a camelid VHH domain. In one embodiment, said cell is T cell. In one embodiment, said cell is an NK cell. In one embodiment, said cell is from an NK cell line, e.g., NK92. In one embodiment, one of said first and said second non-naturally occurring chimeric membrane embedded receptors is a TCAR. In one embodiment, both of said first and said second non-naturally occurring chimeric membrane embedded receptors is a TCAR. In one embodiment, one of said first and said second non-naturally occurring chimeric membrane embedded receptors is a NKR-CAR, e.g., a KIR-CAR. In one embodiment, both of said first and said second non-naturally occurring chimeric membrane embedded receptors is a NKR-CAR, e.g., a KIR-CAR. In one embodiment, the antigen binding domain of one of said first and said second non-naturally occurring chimeric membrane embedded receptor does not comprise a light chain variable domain and a heavy chain variable domain. In one embodiment, when present on the surface of a cell, the antigen binding domains of said first and said second non-naturally occurring chimeric membrane embedded receptor, associate with one another less than if both were scFv antigen binding domains. In one embodiment, when present on the surface of a cell, binding of the antigen binding domain of said first non-naturally occurring chimeric membrane embedded receptor to its cognate antigen is not substantially reduced by the presence of said second non-naturally occurring chimeric membrane embedded receptor. In one embodiment, the antigen binding domain of one of said first and said second non-naturally occurring chimeric membrane embedded receptor, comprises a single VH domain, e.g., a camelid, shark, or lamprey single VH domain, or a single VH domain derived from a human or mouse sequence or a non-antibody scaffold, e.g., a fibronectin, e.g., a fibronectin type III antibody-like molecule. In one embodiment, the antigen binding domain of one of said first said second non-naturally occurring chimeric membrane embedded receptor, comprises an scFv, and the other comprises a single VH domain, e.g., a camelid, shark, or lamprey single VH domain, or a single VH domain derived from a human or mouse sequence or a non-antibody scaffold, e.g., a fibronectin, e.g., a fibronectin type III antibody-like molecule. In one embodiment, the antigen binding domain of one of said first and said second non-naturally occurring chimeric membrane embedded receptor, comprises an scFv, and the other comprises a nanobody. In one embodiment, the antigen binding domain of one of said first and said second non-naturally occurring chimeric membrane embedded receptor, comprises an scFv, and the other comprises a camelid VHH domain. In one embodiment, the invention comprises a nucleic acid, e.g., a purified or non-naturally occurring, nucleic acid, comprising a sequence that encodes a first and second non-naturally occurring chimeric membrane embedded receptor comprising an antigen binding domain described herein. In one embodiment, the invention comprises a method of making a cell described herein comprised introducing into a cell the nucleic acid described herein. In one embodiment, the invention comprises a method of making a cell described herein, comprising, forming in a cytotoxic cell, a first and said second non-naturally occurring chimeric membrane embedded receptor described herein. In one embodiment, the invention comprises a method of treating a subject e.g., a method of providing an anti-tumor immunity in a mammal, comprising administering to the mammal an effective amount of a cell described herein.

In another aspect, the invention features a kit comprising a cell or nucleic acid described herein.

In another aspect, the invention features an isolated nucleic acid sequence encoding a KIR-CAR (killer cell immunoglobulin receptor-like-chimeric antigen receptor), wherein the isolated nucleic acid sequence comprises the nucleic acid sequence of an antigen binding domain and a KIR or fragment thereof. In one embodiment, the antigen binding domain is selected from the group consisting of a murine antibody, a humanized antibody, a human antibody, a chimeric antibody, and a fragment thereof. In one embodiment, the fragment is a Fab or an scFv. In one embodiment, the antigen binding domain is an antigen binding domain described herein, e.g., in Table 4. In one embodiment, the KIR is selected from the group consisting of an activating KIR, an inhibitory KIR, and any combination thereof. In one embodiment, at least one hinge region has been removed from the activating KIR.

In another aspect, the invention features an isolated KIR-CAR (killer cell immunoglobulin-like receptor-chimeric antigen receptor) comprising an antigen binding domain and a KIR or fragment thereof. In one embodiment, the antigen binding domain is selected from the group consisting of a murine antibody, a humanized antibody, a human antibody, a chimeric antibody, and a fragment thereof. In one embodiment, the fragment is a Fab or an scFv. In one embodiment, the antigen binding domain is an antigen binding domain described herein, e.g., in Table 4. In one embodiment, the KIR is selected from the group consisting of an activating KIR, an inhibitory KIR, and any combination thereof. In one embodiment, at least one hinge region has been removed from the activating KIR.

In another aspect, the invention features a composition comprising at least two KIR-CARs, wherein the first KIR-CAR comprises an antigen binding domain and an activating KIR or fragment thereof and the second KIR-CAR comprises an antigen binding domain and an inhibitory KIR or fragment thereof. In one embodiment, the antigen binding domain in the first KIR-CAR is specific for an antigen present on a tumor, e.g., an antigen binding domain described herein, e.g., in Table 4, and the antigen binding domain in the second KIR-CAR is specific for an antigen present on a normal cell.

In another aspect, the invention features a genetically modified T cell comprising at least two KIR-CARs, wherein the first KIR-CAR comprises an antigen binding domain and an activating KIR or fragment thereof and the second KIR-CAR comprises an antigen binding domain and an inhibitory KIR or fragment thereof. In one embodiment, the antigen binding domain in the first KIR-CAR is specific for an antigen present on a tumor, e.g., an antigen binding domain described herein, e.g., in Table 4, and the antigen binding domain in the second KIR-CAR is specific for an antigen present on a normal cell. In one embodiment, the cell is a T cell.

In another aspect, the invention features a method of providing an anti-tumor immunity in a mammal, the method comprising administering to the mammal an effective amount of a cell comprising at least two KIR-CARs, wherein the first KIR-CAR comprises an antigen binding domain and an activating KIR or fragment thereof and the second KIR-CAR comprises an antigen binding domain and an inhibitory KIR or fragment thereof. In one embodiment, the antigen binding domain in the first KIR-CAR is specific for an antigen present on a tumor, e.g., an antigen binding domain described herein, e.g., in Table 4, and the antigen binding domain in the second KIR-CAR is specific for an antigen present on a normal cell, thereby controlling the off-target activity of the cell. In one embodiment, the cell is a T cell.

In another aspect, the invention features a method of treating a subject having a disease associated with expression of tumor antigen, e.g., a tumor antigen described herein (e.g., a proliferative disease, a precancerous condition, and a noncancer related indication associated with the expression of a tumor antigen) comprising administering to the mammal an effective amount of a cell comprising at least two KIR-CARs, wherein the first KIR-CAR comprises an antigen binding domain and an activating KIR or fragment thereof and the second KIR-CAR comprises an antigen binding domain and an inhibitory KIR or fragment thereof.

In one embodiment, the first KIR-CAR comprises an antigen binding domain described herein, e.g., in Table 4.

In one embodiment, the disease associated with expression of a tumor antigen is cancer, e.g., a cancer described herein. In one embodiment, the cancer is a solid tumor, e.g., a solid tumor described herein, e.g., mesothelioma (e.g., malignant pleural mesothelioma), lung cancer (e.g., non-small cell lung cancer, small cell lung cancer, squamous cell lung cancer, or large cell lung cancer), pancreatic cancer (e.g., pancreatic ductal adenocarcinoma), ovarian cancer, colorectal cancer and bladder cancer or any combination thereof. In one embodiment, the disease is pancreatic cancer, e.g., metastatic pancreatic ductal adenocarcinoma (PDA), e.g., in a subject who has progressed on at least one prior standard therapy. In one embodiment, the disease is mesothelioma (e.g., malignant pleural mesothelioma), e.g., in a subject who has progressed on at least one prior standard therapy. In one embodiment, the disease is ovarian cancer, e.g., serous epithelial ovarian cancer, e.g., in a subject who has progressed after at least one prior regimen of standard therapy.

Unless otherwise defined, all technical and scientific terms used herein have the same meaning as commonly understood by one of ordinary skill in the art to which this invention belongs. Although methods and materials similar or equivalent to those described herein can be used in the practice or testing of the present invention, suitable methods and materials are described below. All publications, patent applications, patents, and other references mentioned herein are incorporated by reference in their entirety. In addition, the materials, methods, and examples are illustrative only and not intended to be limiting. Headings, sub-headings or numbered or lettered elements, e.g., (a), (b), (i) etc, are presented merely for ease of reading. The use of headings or numbered or lettered elements in this document does not require the steps or elements be performed in alphabetical order or that the steps or elements are necessarily discrete from one another.

Other features, objects, and advantages of the invention will be apparent from the description and drawings, and from the claims.

BRIEF DESCRIPTION OF THE DRAWINGS

The following detailed description of preferred embodiments of the invention will be better understood when read in conjunction with the appended drawings. For the purpose of illustrating the invention, there are shown in the drawings embodiments which are presently preferred. It should be understood, however, that the invention is not limited to the precise arrangements and instrumentalities of the embodiments shown in the drawings.

FIGS. 1A and 1B, is a series of schematics showing the structure of naturally occurring inhibitory and activating KIRs (FIG. 1A) and a scFv-based activating KIR-CAR (FIG. 1B).

FIGS. 5A and 5B, is a series of schematics showing an activating KIR CAR in which the KIR2DS2 hinge was removed (KIR2S CAR). Based upon the kinetic segregation model of TCR activation diagrammed in FIG. 5A, it is believed that the mesothelin-specific SS1 KIR CAR has a hinge that is too long to permit appropriate segregation. Therefore making the mesothelin-specific KIR CAR hinge shorter is believed to improve the function. FIG. 5B is a schematic showing that the SS1 scFv was fused to the KIR transmembrane domain without the two Ig-like domains from KIR2DS2 as the hinge.

FIGS. 6A and 6B, is a series of images demonstrating that SS1 scFv based KIRS2 CAR exhibits enhanced cytolytic activity towards mesothelin-expressing target cells compared with the CAR formed by fusion of the SS1 scFv onto full length wildtype KIR2DS2. Primary human T cells were stimulated with CD3/28 microbeads followed by lentiviral transduction with either the SS1-KIR2DS2 activating KIR-CAR, SS1-KIRS2 activating KIR CAR, the SS1-zeta CAR. Mock non-transduced T cells (NTD) were used as a control. The T cells were expanded until the end of log-phase growth. The surface expression of the SS1-specific CARs was determined by flow cytometry using a biotinylated goat anti-mouse F(ab)2 specific polyclonal antibody followed by streptavidin-PE detection as shown in FIG. 6A. Shown in FIG. 6B, K562 target cells with or without mesothelin and stained with CFSE were mixed with the effector T cells characterized in FIG. 6A as indicated using varying effector T cell to target ratios ranging from 10:1 to 1:1. Target K562 cell lysis was assessed using flow cytometry to determine the % of viable CFSE+ cells as described for FIG. 4. Data shown is the calculated % target cell lysis compared against target cells without effector cells.

FIGS. 7A and 7B, is a series of images showing co-expression of the CD19 actKIR-CAR and the SS1 inhKIR-CAR. Jurkat NFAT-GFP reporter cells were transduced with the indicated KIR CAR or non-transduced (NDT) and mixed 1:1 with target cells with or without the CD19 and mesothelin antigens as indicated. Results shows GFP expression at 24 hours following mixing of Jurkat and Target cells (FIG. 7A). FIG. 7B shows surface expression of the mesothelin and CD19 idiotypes as determined by staining with a mesothelin-Fc fusion protein and a monoclonal antibody specific for the FMC63 anti-CD19 scFv idiotype.

FIGS. 8A, 8B, and 8C, is a series of images demonstrating co-expression of wild-type PD-1 with both an activating KIR-based CAR or TCR-zeta based CAR targeting mesothelin. Primary human T cells were stimulated with CD3/28 microbeads followed by lentiviral transduction with either the SS1-KIRS2 activating KIR CAR or the SS1-zeta CAR. Mock non-transduced cells (NTD) were used as a negative control. The T cells were expanded over 9 days, and surface CAR expression was determined by staining with mesothelin-Fc followed by a goat-anti-human Fc specific antibody conjugated to PE (FIG. 8A). K562 cell lines (wildtype [wt], mesothelin expressing [meso] or mesothelin and PD-L1 co-expressing [meso-PDL1]) were stained using the CAK1 anti-mesothelin specific monoclonal antibody to confirm mesothelin expression on the targets (FIG. 8B). The primary human T cells transduced as shown in FIG. 8A were electroporated with 10 ug of in vitro transcribed RNA encoding wild-type PD1 using a BTX ECM830 electroporator (PD1+) or mock transfected (PD1−). The surface expression of PD-1 was expressed using an anti-PD1 monoclonal conjugated to APC (FIG. 8C).

FIGS. 12A-12B, depicts construction of a mesothelin-specific KIR-based chimeric antigen receptor (KIR-CAR) engineered T cell with robust cytotoxic activity. Primary human T cells were stimulated with CD3/28 microbeads followed by transduction with a lentiviral vector expressing either GFP and dsRed (Control) or DAP12 and dsRed (DAP12). The cells were expanded ex vivo until the end of log phase growth. $5\times10^6$ T cells from each transduced population were electroporated with 10 ug of in vitro transcribed RNA encoding SS1-KIRS2 using a BTX ECM830 electroporator. The expression of both dsRed and SS1-KIRS2 was assessed by flow cytometry with the SS1-KIRS2 detected using a biotinylated goat anti-mouse F(ab)2 specific polyclonal antibody followed by streptavidin-PE. The upper panel of FIG. 12A shows the gating strategy for identification of T cells expressing dsRed, which were then analyzed for SS1-KIRS2 expression as shown in the lower portion of the panel. FIG. 12B shows the ability of the cells characterized in FIG. 12A to mediate cytotoxicity against wild-type K562 cells (K562-wt) or K562 cells that express mesothelin (K562-mesothelin) as assessed using a 4-hr $^{51}$Cr-release assay.

FIG. 15A shows an experiment in which NOD-SCID-$\gamma_c^{-/-}$ (NSG) mice were subcutaneously implanted with $2\times10^6$ mesothelioma-derived cells expressing mesothelin (EM-meso cells). 20 days following tumor implantation, each animal was injected intravenously with $5\times10^6$ T cells that were stimulated with anti-CD3/anti-CD28 stimulator beads followed lentiviral transduction with a series of CD3ζ-based CAR with or without a costimulatory domain (SS1-ζ, SS1-BBζ and SS1-28ζ) or the mesothelin-specific KIR-based CARs, SS1-KIRS2 with DAP12. Mock transduced T cells (NTD) used as a control. Tumor volume was measured by caliper at the indicated times (n=7 mice per group). FIG. 15B shows that the in vivo activity of the KIR-CAR is independent of T cell engraftment in blood, spleen or tumor. The frequency of human CD45+ T cells was assessed at the end of the experiment by flow cytometry, and data are expressed as a percentage of total viable cells in the blood, spleen and tumor digest. FIG. 15C shows comparable frequencies of CD3+ TILs were observed in SS1-28ζ and SS1-KIRS2/DAP12 CAR T cell treated groups. The same model as that shown in FIG. 15A was used. The frequency of CD3+ human lymphocytes in tumors at day 30 (10 days following CAR T infusion) was assessed by flow cytometry. FIG. 15D shows that DAP12-modified T cells require the mesothelin-specific KIR-based CAR for tumor eradication. The same model as that shown in FIG. 15A was used. 4 million T cells expressing DAP12 and dsRed (DAP12), SS1-28z or SS1-KIRS2 and DAP12 (SS1-KIRS2) were injected intravenously on day 20, and tumor volume was assessed over time via caliper measurement. The arrow indicates the time of TIL isolation used for functional and phenotypic analysis. FIG. 15E shows antigen-specific cytotoxic activity of TILs isolated from the mice described in FIG. 15D. Antigen-specific cytotoxicity was assessed by coculturing with firefly luciferase expressing EM-meso cells or EMp cells (parental EM cells lacking mesothelin expression) at indicated E:T ratios for 18 hours.

FIGS. 17A and 17B shows CD19-KIRS2 in vivo activity. NOD-SCID-$\gamma_c^{-/-}$ (NSG) mice were engrafted intravenously by tail vein injection on day 0 of 1 million Nalm-6 CBG tumor cells, a leukemic cell line expressing CD19. T cells were stimulated with anti-CD3/anti-CD28 stimulator beads followed by lentiviral transduction on day 1 with a series of CD19-specific CD3ζ-based CAR with or without a costimulatory domain (CD19z, 19BBz) or the CD19-specific KIR-based CARs, CD19-KIRS2 with DAP12 (19KIRS2). Mock non-transduced T cells (NTD) were used as a control. The T cells were expanded until the end of log-phase growth ex vivo and injected intravenously on day 5 post leukemic cell line injection with 2 million CAR T cells per mouse. Tumor burden was assessed via bioluminescent imaging. 5 animals were analyzed for each T cell condition. FIG. 17A shows the individual bioluminescent photon flux for individual animals on day 5 (baseline prior to T cell injection) and at day 15 following leukemic cell engraftment. FIG. 17B shows the median total flux for each treatment group over time.

FIGS. 27A and 27B, depict the putative mechanism for loss of scFv binding when two scFv molecules are co-expressed on the cell surface (FIG. 27A) and the putative avoidance of this interaction when a camelid single VHH domain-based CAR is expressed on a T cell surface in combination with a scFv-based CAR.

Figure 28:
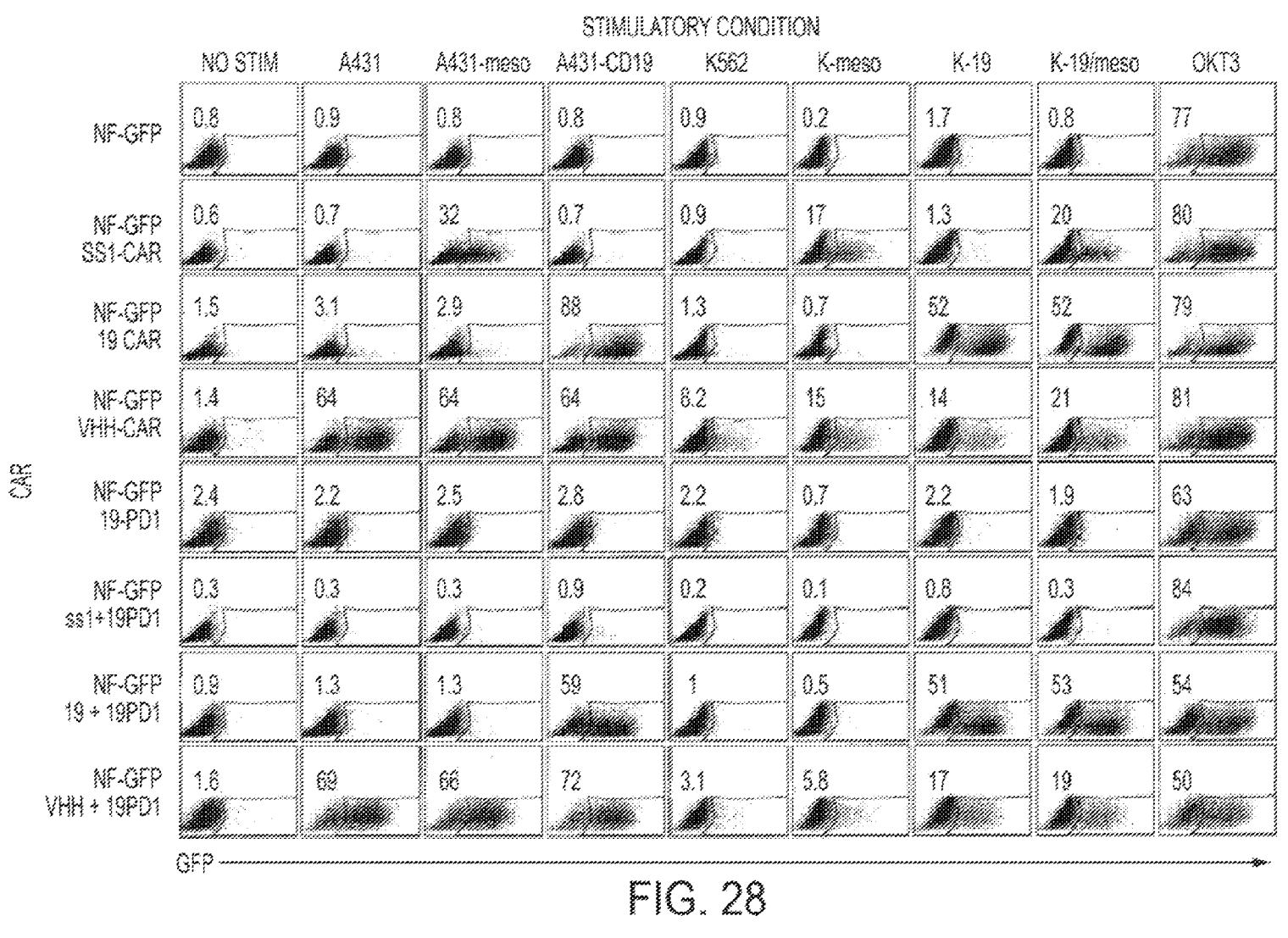

FIG. 28 demonstrates a camelid single VHH domain-based CAR can be expressed on a T cell surface in combination with a scFv-based CAR without appreciable receptor interaction. Jurkat T cells expressing GFP under an NFAT-dependent promoter (NF-GFP) were transduced with either a mesothelin-specific activating CAR (SS1-CAR), CD19-specific activating (19-CAR) or a CAR generated using a camelid VHH domain specific to EGFR (VHH-CAR). Following transduction with the activating CAR, the cells were then transduced with an additional inhibitory CAR recognizing CD19 (19-PD1) to generate cells co-expressing both the activating and inhibitory CAR (SS1+19PD1, 19+19PD1 or VHH+19PD1). The transduced Jurkat T cells were co-cultured for 24 hours with different cell lines that are either 1) devoid of all target antigens (K562), 2) express mesothelin (K-meso), CD19 (K-19) or EGFR (A431) only, 3) express a combination of EGFR and mesothelin (A431-mesothelin) or CD19 (A431-CD19) or 4) express a combination of CD19 and mesothelin (K-19/meso). Additional conditions that include either no stimulator cells (no stim) or K562 with 1 ug/mL of OKT3 (OKT3) were also included as negative and positive controls for NFAT activation, respectively. GFP expression, as a marker of NFAT activation, was assessed by flow cytometry.

FIGS. 39A, 39B, and 39C, is a schematic showing the structure of mesothelin-specific CARs. FIG. 39A represents a mesothelin-specific multi-chain KIR-CAR. FIG. 39B represents a mesothelin-specific single chain KIR-CAR containing DAP12. FIG. 39C represents a mesothelin-specific CAR containing CD28 and CD3zeta signaling domains.

FIG. 42, comprising

FIG. 43, comprising FIG. 43A shows IFN-gamma production; FIG. 43B shows IL-2 cytokine production.

FIG. 44, comprising FIGS. 44A, 44B, 44C, 44D, and 44E, shows the various configurations on a single vector, e.g., where the U6 regulated shRNA is upstream or downstream of the EF1 alpha regulated CAR encoding elements. In the exemplary constructs depicted in FIGS. 44A and 44B, the transcription occurs through the U6 and EF1 alpha promoters in the same direction. In the exemplary constructs depicted in FIGS. 44C and 44D, the transcription occurs through the U6 and EF1 alpha promoters in different directions. In FIG. 44E, the shRNA (and corresponding U6 promoter) is on a first vector, and the CAR (and corresponding EF1 alpha promoter) is on a second vector.

FIG. 48, comprising FIG. 48A shows day 0 PK following the first dose of RAD001. FIG. 48B shows Day 14 PK following the final RAD001 dose. Diamonds denote the 10 mg/kg dose of RAD001; squares denote the 1 mg/kg dose of RAD001; triangles denote the 3 mg/kg dose of RAD001; and x's denote the 10 mg/kg dose of RAD001.

FIG. 49, comprising FIG. 49A shows CD4$^+$ CAR T cells; FIG. 49B shows CD8$^+$ CAR T cells. Circles denote PBS; squares denote huCTL019; triangles denote huCTL019 with 3 mg/kg RAD001; inverted triangles denote huCTL019 with 0.3 mg/kg RAD001; diamonds denote huCTL019 with 0.03 mg/kg RAD001; and circles denote huCTL019 with 0.003 mg/kg RAD001.

DETAILED DESCRIPTION

Figure 1:
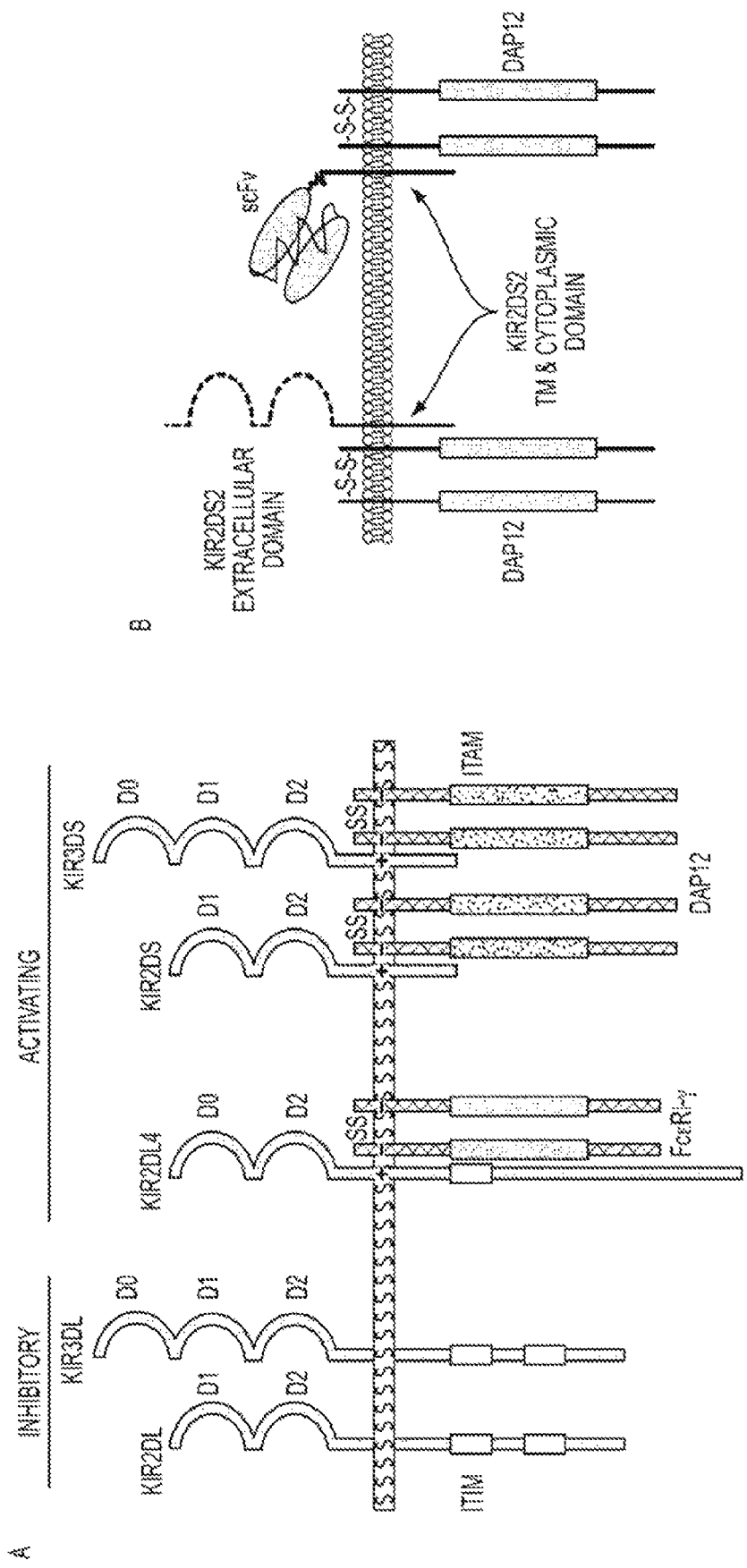
FIG. 1, comprising

In one aspect, the present invention provides compositions and methods for regulating the specificity and activity of T cells, or other cytotoxic cells, e.g., NK cells. In an embodiment, a chimeric antigen receptor (a CAR), e.g., a NK cell receptor CAR (a NKR-CAR) based on an NK cell receptor (a NKR), e.g., a KIR-CAR, a NCR-CAR, a SLAMF-CAR, a FcR-CAR, or a Ly49-CAR is provided. In one embodiment, the invention provides a type of chimeric antigen receptor (CAR) wherein the CAR is termed an NKR, e.g., a "KIR-CAR," which is a CAR design comprising a component of a receptor found on natural killer (NK) cells. In one embodiment, the NK receptor includes but is not limited to a killer cell immunoglobulin-like receptor (KIR). KIRs can function as an activating KIR or an inhibiting KIR.

One advantage of the NKR-CARs, e.g., KIR-CARs, of the invention is that a NKR-CAR, e.g., a KIR-CAR, provides a method for regulating cytotoxic cell, e.g., T cell, specificity to control off-target activity of the engineered T cell. In some instances, the KIR-CARs of the invention do not require a costimulation to proliferate.

NKR-CARs can deliver a signal through an adaptor protein, e.g., an ITAM containing adaptor protein. In one embodiment, the KIR-CARs of the invention comprise an activating KIR which delivers its signal through an interaction with the immunotyrosine-based activation motif (ITAM) containing membrane protein, DAP12 that is mediated by residues within the transmembrane domains of these proteins.

In an embodiment, a NKR-CAR can deliver an inhibitory signal by means of an inhibitory motif. In one embodiment, the KIR-CARs of the invention comprise an inhibitory KIR which delivers its signal through an interaction with the immunotyrosine-based inhibitory motifs (ITIMs). KIRs bearing cytoplasmic domains that contain ITIMs abrogate the activating signal leading to inhibition of NK cytolytic and cytokine producing activity. However, the invention should not be limited to inhibitory KIRs. Rather, any inhibitory protein having a cytoplasmic domain that is associated with an inhibitory signal can be used in the construction of the CARs of the invention.

Accordingly, the invention provides a composition comprising a NKR-CAR, e.g., a KIR-CAR, vectors comprising the same, compositions comprising a NKR-CAR, e.g., a KIR-CAR, vectors packaged in viral particles, and recombinant T cells or other cytotoxic cells comprising a NKR-CAR, e.g., a KIR-CAR. The invention also includes methods of making a genetically modified T cell or other cytotoxic cell, e.g., a NK cell, or cultured NK cell, e.g., a NK92 cell, expressing a NKR-CAR, e.g., a KIR-CAR (KIR-CART), wherein the expressed NKR-CAR, e.g., a KIR-CAR, comprises an antigen recognition domain of a specific antibody with an intracellular signaling molecule from a NKR, e.g., a KIR. For example, in some embodiments, the intracellular signaling molecule includes, but is not limited to, a KIR ITAM, a KIR ITIM, and the like.

Accordingly, the invention provides compositions and methods to regulate the specificity and activity of T cells or other cytotoxic cells modified to express a NKR-CAR, e.g., a KIR-CAR. The present invention also provides cells comprising a plurality of types of NKR-CARs, e.g., KIR-CARs (e.g. activating NKR-CARs, e.g., KIR-CARs and inhibiting NKR-CAR, e.g., a KIR-CAR), wherein the plurality of types of NKR-CARs, e.g., KIR-CARs, participate in signaling to regulate T cell activation. In this aspect, it is beneficial to effectively control and regulate NKR-CAR cytotoxic cells, e.g., KIR-CAR T cells, such that they kill tumor cells while not affecting normal bystander cells. Thus, in one embodiment, the present invention also provides methods of killing cancerous cells while minimizing the depletion of normal non-cancerous cells, thereby improving the specificity of a NKR-CAR, e.g., a KIR-CAR, therapy.

In one embodiment, the NKR-CAR, e.g., KIR-CAR approach includes the physical separation of a plurality of types of CARs expressed on a cell, wherein binding of a plurality of types of NKR-CARs, e.g., KIR-CARs, to their target antigen is required for NKR-CAR cytotoxic cell, e.g., KIR-CAR T cell, activation. For example in the KIR-CAR approach, each KIR-CAR from the plurality of type of KIR-CARs have different intracellular signaling domain. For example, when a plurality of types of KIR-CARs is used to induce KIR-CAR T cell activation, the first type of KIR-CARs can only comprise an intracellular domain from an activating KIR and the second type of CAR can only comprise an intracellular domain from an inhibiting KIR. In this manner, conditional activation of T cells is generated by engagement of the activating KIR-CAR (actKIR-CAR) to an antigen on a malignant cell of interest. An inhibitory KIR-CAR (inhKIR-CAR) bearing an antigen binding domain directed against an antigen that is present on a normal, but not malignant cell provides dampening of the activating effects from the actKIR-CAR when the T cell encounters normal cells.

In one embodiment, the present invention provides a T cell or other cytotoxic cell engineered to express at least two NKR-CARs, e.g., at least two KIR-CARs, wherein the first NKR-CAR, e.g., a KIR-CAR, is an actNKR-CAR, e.g., an actKIR-CAR, and the second NKR-CAR, e.g., a KIR-CAR, is an inhNKR-CAR, e.g., an inhKIR-CAR. In one embodiment, the invention provides an inhNKR-CAR, e.g., an inhKIR-CAR, wherein binding of the inhNKR-CAR, e.g., an inhKIR-CAR, to a normal cell results in inhibition of the cytotoxic cell, e.g., inhibition of KIR-CAR T cell activity. In one embodiment, binding of the inhNKR-CAR, e.g., an inhKIR-CAR, to an antigen associated with a non-cancerous cell results in the death of the NKR-CAR cytotoxic cell, e.g., a KIR-CAR T cell.

In one embodiment, an inhNKR-CAR, e.g., an actKIR-CAR, of the invention can be used in combination with existing CARs in order to regulate the activity of the CARs. Exemplary CARs have been described in PCT/US11/64191, which is incorporated in its entirety by reference herein.

It has also been discovered that, in cells having a plurality of chimeric membrane embedded receptors comprising an antigen binding domain (CMERs), interactions between the antigen binding domain of the CMERs can be undesirable, e.g., because interaction inhibits the ability of one or more of the antigen binding domains to bind its cognate antigen or might generate novel binding sites with unknown cognate antigen. Accordingly, disclosed herein are cells having a first and a second non-naturally occurring CMER wherein the antigen binding domains minimizes such interactions. Also disclosed herein are nucleic acids encoding a first and a second non-naturally occurring such CMERs, as well as methods of making and using such cells and nucleic acids. In an embodiment, the antigen binding domain of one of said first said second non-naturally occurring CMER, comprises an scFv, and the other comprises a single VH domain, e.g., a camelid, shark, or lamprey single VH domain, or a single VH domain derived from a human or mouse sequence or a non-antibody scaffold.

Definitions

Unless defined otherwise, all technical and scientific terms used herein have the same meaning as commonly understood by one of ordinary skill in the art to which the invention pertains. Although any methods and materials similar or equivalent to those described herein can be used in the practice of and/or for the testing of the present invention, the preferred materials and methods are described herein. In describing and claiming the present invention, the following terminology will be used according to how it is defined, where a definition is provided.

It is also to be understood that the terminology used herein is for the purpose of describing particular embodiments only, and is not intended to be limiting.

The articles "a" and "an" are used herein to refer to one or to more than one (i.e., to at least one) of the grammatical object of the article. By way of example, "an element" means one element or more than one element.

"About" as used herein when referring to a measurable value such as an amount, a temporal duration, and the like, is meant to encompass variations of ±20% or ±10%, in some instances ±5%, in some instances ±1%, and in some instance ±0.1% from the specified value, as such variations are appropriate to perform the disclosed methods.

The term "adaptor molecule", as that term is used herein, refers to a polypeptide with a sequence that permits interaction with two or more molecules, and in embodiments, promotes activation or inactivation of a cytotoxic cell. E.g., in the case of DAP12, this comprises interactions with an activating KIR via charge interactions within the transmembrane domain and interactions with signaling molecules like ZAP70 or Syk via a phosphorylated ITAM sequence within the cytoplasmic domain.

The term "antigen" or "Ag" as used herein is defined as a molecule that provokes an immune response. This immune response may involve either antibody production, or the activation of specific immunologically-competent cells, or both. The skilled artisan will understand that any macromolecule, including virtually all proteins or peptides, can serve as an antigen. Furthermore, antigens can be derived from recombinant or genomic DNA. A skilled artisan will understand that any DNA, which comprises a nucleotide sequences or a partial nucleotide sequence encoding a protein that elicits an immune response therefore encodes an "antigen" as that term is used herein. Furthermore, one skilled in the art will understand that an antigen need not be encoded solely by a full length nucleotide sequence of a gene. It is readily apparent that the present invention includes, but is not limited to, the use of partial nucleotide sequences of more than one gene and that these nucleotide sequences are arranged in various combinations to encode polypeptides that elicit the desired immune response. Moreover, a skilled artisan will understand that an antigen need not be encoded by a "gene" at all. It is readily apparent that an antigen can be generated synthesized or can be derived from a biological sample. Such a biological sample can include, but is not limited to a tissue sample, a tumor sample, a cell or a biological fluid.

The term "anti-tumor effect" as used herein, refers to a biological effect which can be manifested by a decrease in tumor volume, a decrease in the number of tumor cells, a decrease in the number of metastases, an increase in life expectancy, or amelioration of various physiological symptoms associated with the cancerous condition. An "anti-tumor effect" can also be manifested by the ability of the peptides, polynucleotides, cells and antibodies of the invention in prevention of the occurrence of tumor in the first place.

The term "apheresis" as used herein refers to an extracorporeal process by which the blood of a donor or patient is removed from the donor or patient and passed through an apparatus that separates out selected particular constituent(s) and returns the remainder to the circulation of the donor or patient, e.g., by retransfusion. Thus, in the context of "an apheresis sample" refers to a sample obtained using apheresis.

The term "auto-antigen" means, in accordance with the present invention, any self-antigen which is recognized by the immune system as if it were foreign. Auto-antigens comprise, but are not limited to, cellular proteins, phosphoproteins, cellular surface proteins, cellular lipids, nucleic acids, glycoproteins, including cell surface receptors.

The term "autoimmune disease" as used herein is defined as a disorder that results from an autoimmune response. An autoimmune disease is the result of an inappropriate and excessive response to a self-antigen. Examples of autoimmune diseases include but are not limited to, Addison's disease, alopecia areata, ankylosing spondylitis, autoimmune hepatitis, autoimmune parotitis, Crohn's disease, diabetes (Type I), dystrophic epidermolysis bullosa, epididymitis, glomerulonephritis, Graves' disease, Guillain-Barr syndrome, Hashimoto's disease, hemolytic anemia, systemic lupus erythematosus, multiple sclerosis, myasthenia gravis, pemphigus vulgaris, psoriasis, rheumatic fever, rheumatoid arthritis, sarcoidosis, scleroderma, Sjogren's syndrome, spondyloarthropathies, thyroiditis, vasculitis, vitiligo, myxedema, pernicious anemia, ulcerative colitis, among others.

As used herein, the term "autologous" is meant to refer to any material derived from the same individual to which it is later to be re-introduced into the individual.

The term "allogeneic" as used herein refers to any material derived from a different animal of the same species as the individual to whom the material is introduced. Two or more individuals are said to be allogeneic to one another when the genes at one or more loci are not identical. In some aspects, allogeneic material from individuals of the same species may be sufficiently unlike genetically to interact antigenically. In an embodiment, allogeneic refers to a graft derived from a different animal of the same species.

"Chimeric Antigen Receptor": or "CAR", as that term is used herein, refers to a chimeric polypeptide that shares structural and functional properties with a cell immune-function receptor or adaptor molecule, from e.g., a T cell or a NK cell. CARs include TCARs and NKR-CARs. In embodiments, the CAR comprises an antigen binding domain that binds to a cognate antigen, e.g., a tumor antigen described herein. Upon binding to cognate antigen, a CAR can activate or inactivate the cytotoxic cell in which it is disposed, or modulate the cell's antitumor activity or otherwise modulate the cell's immune response.

In some embodiments, the domains in the CAR polypeptide construct are in the same polypeptide chain, e.g., comprise a chimeric fusion protein. In some embodiments, the domains in the CAR polypeptide construct are not contiguous with each other, e.g., are in different polypeptide chains, e.g., as provided in an RCAR as described herein.

"Natural killer cell immune function receptor chimeric antigen receptor" or "NKR-CAR", as that term is used herein, refers to a CAR which shares functional and structural properties with a natural killer cell immune function receptor (NKR) or adaptor molecule from a NK cell. In embodiments, an NKR-CAR comprises two or all of an antigen binding domain, a transmembrane domain, e.g., an NKR transmembrane domain, and/or a cytoplasmic domain, e.g., an NKR cytoplasmic domain.

"Fc receptor-chimeric antigen receptor" or "FcR-CAR", as that term is used herein, refers to a CAR which shares functional and structural properties with a Fc receptor (FcR). "Killer cell immunoglobulin-like receptor-chimeric antigen receptor" or "KIR-CAR", as that term is used herein, refers to a CAR which shares functional and structural properties with a killer cell immunoglobulin-like receptor (KIR).

"Ly49 receptor-chimeric antigen receptor" or "Ly49-CAR", as that term is used herein, refers to a CAR which shares functional and structural properties with a Ly49 receptor (Ly49).

"Natural cytotoxicity receptor-chimeric antigen receptor" or "NCR-CAR", as that term is used herein, refers to a CAR which shares functional and structural properties with a natural cytotoxicity receptor (NCR).

"Signaling lymphocyte activation molecule family-chimeric antigen receptor" or "SLAM-CAR", or "SLAMF-CAR", as that term is used herein, refers to a CAR which shares functional and structural properties with a SLAM or a SLAMF.

"T cell based-chimeric antigen receptor" or "TCAR", as that term is used herein, refers to a CAR which shares functional and structural properties with a cell immune-function receptor or adaptor molecule from a T cell. In embodiments, a TCAR comprises an antigen domain, a primary intracellular signaling domain, and optionally one or more costimulatory signaling domains.

The term "antibody," as used herein, refers to a protein, or polypeptide sequence derived from an immunoglobulin molecule which specifically binds with a target antigen. An antibody can be intact immunoglobulin derived from natural sources or from recombinant sources and can be an immunoreactive portion of intact immunoglobulin. Antibodies can be polyclonal or monoclonal, multiple or single chain, or intact immunoglobulins, and may be derived from natural sources or from recombinant sources. Antibodies are typically tetramers of immunoglobulin molecules. The antibody molecule described herein may exist in a variety of forms where the antigen binding portion of the antibody is expressed as part of a contiguous polypeptide chain including, for example, a single domain antibody fragment (sdAb), a single chain antibody (scFv) and a humanized or human antibody, e.g., as described herein.

The term "antibody fragment" refers to at least one portion of an intact antibody, or recombinant variants thereof, and refers to the antigenic determining variable regions of an intact antibody that is sufficient to confer recognition and specific binding of the antibody fragment to a target, such as an antigen. Examples of antibody fragments include, but are not limited to, a single chain domain antibody (sdAb), Fab, Fab', F(ab')2, and Fv fragments, linear antibodies, scFv antibodies, scFv antibody fragments, a linear antibody, single domain antibody such as an sdAb (either VL or VH), a camelid VHH domain, and multispecific antibodies formed from antibody fragments such as a bivalent fragment comprising two Fab fragments linked by a disulfide brudge at the hinge region, and an isolated CDR or other epitope binding fragments of an antibody. An antigen binding fragment can also be incorporated into single domain antibodies, maxibodies, minibodies, nanobodies, intrabodies, diabodies, triabodies, tetrabodies, v-NAR and bis-scFv (see, e.g., Hollinger and Hudson, Nature Biotechnology 23:1126-1136, 2005). Antigen binding fragments can also be grafted into scaffolds based on polypeptides such as a fibronectin type III (Fn3)(see U.S. Pat. No. 6,703,199, which describes fibronectin polypeptide minibodies).

The term "scFv" refers to a fusion protein comprising at least one antibody fragment comprising a variable region of a light chain and at least one antibody fragment comprising a variable region of a heavy chain, wherein the light and heavy chain variable regions are contiguously linked via a short flexible polypeptide linker, and capable of being expressed as a single chain polypeptide, and wherein the scFv retains the specificity of the intact antibody from which it is derived. Unless specified, as used herein an scFv may have the VL and VH variable regions in either order, e.g., with respect to the N-terminal and C-terminal ends of the polypeptide, the scFv may comprise VL-linker-VH or may comprise VH-linker-VL.

The term "complementarity determining region" or "CDR," as used herein, refers to the sequences of amino acids within antibody variable regions which confer antigen specificity and binding affinity. For example, in general, there are three CDRs in each heavy chain variable region (e.g., HCDR1, HCDR2, and HCDR3) and three CDRs in each light chain variable region (LCDR1, LCDR2, and LCDR3). The precise amino acid sequence boundaries of a given CDR can be determined using any of a number of well-known schemes, including those described by Kabat et al. (1991), "Sequences of Proteins of Immunological Interest," 5th Ed. Public Health Service, National Institutes of Health, Bethesda, Md. ("Kabat" numbering scheme), Al-Lazikani et al., (1997) JMB 273,927-948 ("Chothia" numbering scheme), or a combination thereof. Under the Kabat numbering scheme, in some embodiments, the CDR amino acid residues in the heavy chain variable domain (VH) are numbered 31-35 (HCDR1), 50-65 (HCDR2), and 95-102 (HCDR3); and the CDR amino acid residues in the light chain variable domain (VL) are numbered 24-34 (LCDR1), 50-56 (LCDR2), and 89-97 (LCDR3). Under the Chothia numbering scheme, in some embodiments, the CDR amino acids in the VH are numbered 26-32 (HCDR1), 52-56 (HCDR2), and 95-102 (HCDR3); and the CDR amino acid residues in the VL are numbered 26-32 (LCDR1), 50-52 (LCDR2), and 91-96 (LCDR3). In a combined Kabat and Chothia numbering scheme, in some embodiments, the CDRs correspond to the amino acid residues that are part of a Kabat CDR, a Chothia CDR, or both. For instance, in some embodiments, the CDRs correspond to amino acid residues 26-35 (HCDR1), 50-65 (HCDR2), and 95-102 (HCDR3) in a VH, e.g., a mammalian VH, e.g., a human VH; and amino acid residues 24-34 (LCDR1), 50-56 (LCDR2), and 89-97 (LCDR3) in a VL, e.g., a mammalian VL, e.g., a human VL.

The portion of the CAR composition of the invention comprising an antibody or antibody fragment thereof may exist in a variety of forms where the antigen binding domain is expressed as part of a contiguous polypeptide chain including, for example, a single domain antibody fragment (sdAb), a single chain antibody (scFv) and a humanized or human antibody (Harlow et al., 1999, In: Using Antibodies: A Laboratory Manual, Cold Spring Harbor Laboratory Press, NY; Harlow et al., 1989, In: Antibodies: A Laboratory Manual, Cold Spring Harbor, N.Y.; Houston et al., 1988, Proc. Natl. Acad. Sci. USA 85:5879-5883; Bird et al., 1988, Science 242:423-426). In one aspect, the antigen binding domain of a CAR composition of the invention comprises an antibody fragment. In a further aspect, the CAR comprises an antibody fragment that comprises a scFv.

As used herein, the term "binding domain" or "antibody molecule" (also referred to herein as "anti-target (e.g., mesothelin) binding domain") refers to a protein, e.g., an immunoglobulin chain or fragment thereof, comprising at least one immunoglobulin variable domain sequence. The term "binding domain" or "antibody molecule" encompasses antibodies and antibody fragments. In an embodiment, an antibody molecule is a multispecific antibody molecule, e.g., it comprises a plurality of immunoglobulin variable domain sequences, wherein a first immunoglobulin variable domain sequence of the plurality has binding specificity for a first epitope and a second immunoglobulin variable domain sequence of the plurality has binding specificity for a second epitope. In an embodiment, a multispecific antibody molecule is a bispecific antibody molecule. A bispecific antibody has specificity for no more than two antigens. A bispecific antibody molecule is characterized by a first immunoglobulin variable domain sequence which has binding specificity for a first epitope and a second immunoglobulin variable domain sequence that has binding specificity for a second epitope.

An "antibody heavy chain," as used herein, refers to the larger of the two types of polypeptide chains present in all antibody molecules in their naturally occurring conformations.

An "antibody light chain," as used herein, refers to the smaller of the two types of polypeptide chains present in all antibody molecules in their naturally occurring conformations. κ and λ, light chains refer to the two major antibody light chain isotypes.

By the term "synthetic antibody" or "recombinant antibody", as used herein, is meant an antibody molecule which is generated using recombinant DNA technology, such as, for example, an antibody molecule expressed by a bacteriophage as described herein. The term should also be construed to mean an antibody molecule which has been generated by the synthesis of a DNA molecule encoding the antibody molecule and which DNA molecule expresses an antibody protein, or an amino acid sequence specifying the antibody, wherein the DNA or amino acid sequence has been obtained using synthetic DNA or amino acid sequence technology which is available and well known in the art.

The term "cancer" as used herein is defined as disease characterized by the rapid and uncontrolled growth of aberrant cells. Cancer cells can spread locally or through the bloodstream and lymphatic system to other parts of the body. Examples of various cancers include but are not limited to, breast cancer, prostate cancer, ovarian cancer, cervical cancer, skin cancer, pancreatic cancer, colorectal cancer, renal cancer, liver cancer, brain cancer, lymphoma, leukemia, lung cancer, glioma, and the like. The terms "tumor" and "cancer" are used interchangeably herein, e.g., both terms encompass solid and liquid, e.g., diffuse or circulating, tumors. As used herein, the term "cancer" or "tumor" includes premalignant, as well as malignant cancers and tumors.

The term "combination" refers to either a fixed combination in one dosage unit form, or a combined administration where a compound of the present invention and a combination partner (e.g. another drug as explained below, also referred to as "therapeutic agent" or "co-agent") may be administered independently at the same time or separately within time intervals, especially where these time intervals allow that the combination partners show a cooperative, e.g. synergistic effect. The single components may be packaged in a kit or separately. One or both of the components (e.g., powders or liquids) may be reconstituted or diluted to a desired dose prior to administration. The terms "co-administration" or "combined administration" or the like as utilized herein are meant to encompass administration of the selected combination partner to a single subject in need thereof (e.g. a patient), and are intended to include treatment regimens in which the agents are not necessarily administered by the same route of administration or at the same time.

The term "pharmaceutical combination" as used herein means a product that results from the mixing or combining of more than one active ingredient and includes both fixed and non-fixed combinations of the active ingredients. The term "fixed combination" means that the active ingredients, e.g. a compound of the present invention and a combination partner, are both administered to a patient simultaneously in the form of a single entity or dosage. The term "non-fixed combination" means that the active ingredients, e.g. a compound of the present invention and a combination partner, are both administered to a patient as separate entities either simultaneously, concurrently or sequentially with no specific time limits, wherein such administration provides therapeutically effective levels of the two compounds in the body of the patient. The latter also applies to cocktail therapy, e.g. the administration of three or more active ingredients.

As used herein, the term "conservative sequence modifications" is intended to refer to amino acid modifications that do not significantly affect or alter the binding characteristics of the antibody containing the amino acid sequence. Such conservative modifications include amino acid substitutions, additions and deletions. Modifications can be introduced into an antibody of the invention by standard techniques known in the art, such as site-directed mutagenesis and PCR-mediated mutagenesis. Conservative amino acid substitutions are ones in which the amino acid residue is replaced with an amino acid residue having a similar side chain. Families of amino acid residues having similar side chains have been defined in the art. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine, tryptophan), nonpolar side chains (e.g., alanine, valine, leucine, isoleucine, proline, phenylalanine, methionine), beta-branched side chains (e.g., threonine, valine, isoleucine) and aromatic side chains (e.g., tyrosine, phenylalanine, tryptophan, histidine). Thus, for example, one or more amino acid residues within the CDR regions of an antibody of the invention can be replaced with other amino acid residues from the same side chain family and the altered antibody can be tested for the ability to bind FRβ using the functional assays described herein.

A "constitutive" promoter is a nucleotide sequence which, when operably linked with a polynucleotide which encodes or specifies a gene product, causes the gene product to be produced in a cell under most or all physiological conditions of the cell.

Cytoplasmic and intracellular, as applied to adaptor molecules and signaling domains are used interchangeably herein.

"Derived from" as that term is used herein, indicates a relationship between a first and a second molecule. It generally refers to structural similarity between the first molecule and a second molecule and does not connotate or include a process or source limitation on a first molecule that is derived from a second molecule. For example, in the case of an intracellular signaling domain that is derived from a CD3zeta molecule, the intracellular signaling domain retains sufficient CD3zeta structure such that is has the required function, namely, the ability to generate a signal under the appropriate conditions. It does not connotate or include a limitation to a particular process of producing the intracellular signaling domain, e.g., it does not mean that, to provide the intracellular signaling domain, one must start with a CD3zeta sequence and delete unwanted sequence, or impose mutations, to arrive at the intracellular signaling domain.

The term "stimulation," refers to a primary response induced by binding of a stimulatory molecule (e.g., a TCR/CD3 complex) with its cognate ligand thereby mediating a signal transduction event, such as, but not limited to, signal transduction via the TCR/CD3 complex. Stimulation can mediate altered expression of certain molecules, such as downregulation of TGF-β, and/or reorganization of cytoskeletal structures, and the like.

The term "stimulatory molecule," refers to a molecule expressed by a T cell that provides the primary cytoplasmic signaling sequence(s) that regulate primary activation of the TCR complex in a stimulatory way for at least some aspect of the T cell signaling pathway. In one aspect, the primary signal is initiated by, for instance, binding of a TCR/CD3 complex with an MHC molecule loaded with peptide, and which leads to mediation of a T cell response, including, but not limited to, proliferation, activation, differentiation, and the like. A primary cytoplasmic signaling sequence (also referred to as a "primary signaling domain") that acts in a stimulatory manner may contain a signaling motif which is known as immunoreceptor tyrosine-based activation motif or ITAM. Examples of an ITAM containing primary cytoplasmic signaling sequence that is of particular use in the invention includes, but is not limited to, those derived from TCR zeta, FcR gamma, FcR beta, CD3 gamma, CD3 delta, CD3 epsilon, CD5, CD22, CD79a, CD79b, CD278 (also known as "ICOS"), FcεRI, CD66d, DAP10 and DAP12. In a specific CAR of the invention, the intracellular signaling domain in any one or more CARS of the invention comprises an intracellular signaling sequence, e.g., a primary signaling sequence of CD3-zeta. In a specific CAR of the invention, the primary signaling sequence of CD3-zeta is the sequence provided as SEQ ID NO:9, or the equivalent residues from a non-human species, e.g., mouse, rodent, monkey, ape and the like. In a specific CAR of the invention, the primary signaling sequence of CD3-zeta is the sequence as provided in SEQ ID NO:10, or the equivalent residues from a non-human species, e.g., mouse, rodent, monkey, ape and the like.

The term "antigen presenting cell" or "APC" refers to an immune system cell such as an accessory cell (e.g., a B-cell, a dendritic cell, and the like) that displays a foreign antigen complexed with major histocompatibility complexes (MHC's) on its surface. T-cells may recognize these complexes using their T-cell receptors (TCRs). APCs process antigens and present them to T-cells.

An "intracellular signaling domain," as the term is used herein, refers to an intracellular portion of a molecule. The intracellular signaling domain can generate a signal that promotes an immune effector function of the CAR containing cell, e.g., a CART cell or CAR-expressing NK cell. Examples of immune effector function, e.g., in a CART cell or CAR-expressing NK cell, include cytolytic activity and helper activity, including the secretion of cytokines. In embodiments, the intracellular signal domain transduces the effector function signal and directs the cell to perform a specialized function. While the entire intracellular signaling domain can be employed, in many cases it is not necessary to use the entire chain. To the extent that a truncated portion of the intracellular signaling domain is used, such truncated portion may be used in place of the intact chain as long as it transduces the effector function signal. The term intracellular signaling domain is thus meant to include any truncated portion of the intracellular signaling domain sufficient to transduce the effector function signal.

In an embodiment, the intracellular signaling domain can comprise a primary intracellular signaling domain. Exemplary primary intracellular signaling domains include those derived from the molecules responsible for primary stimulation, or antigen dependent simulation. In an embodiment, the intracellular signaling domain can comprise a costimulatory intracellular domain. Exemplary costimulatory intracellular signaling domains include those derived from molecules responsible for costimulatory signals, or antigen independent stimulation. For example, in the case of a CAR-expressing immune effector cell, e.g., CART cell or CAR-expressing NK cell, a primary intracellular signaling domain can comprise a cytoplasmic sequence of a T cell receptor, and a costimulatory intracellular signaling domain can comprise cytoplasmic sequence from co-receptor or costimulatory molecule.

A primary intracellular signaling domain can comprise a signaling motif which is known as an immunoreceptor tyrosine-based activation motif or ITAM. Examples of ITAM containing primary cytoplasmic signaling sequences include, but are not limited to, those derived from CD3 zeta, FcR gamma, FcR beta, CD3ζ gamma, CD3ζ delta, CD3ζ epsilon, CD5, CD22, CD79a, CD79b, CD278 ("ICOS"), FcεRI, CD66d, DAP10, and DAP12.

The term "zeta" or alternatively "zeta chain", "CD3-zeta" or "TCR-zeta" is defined as the protein provided as GenBan Acc. No. BAG36664.1, or the equivalent residues from a non-human species, e.g., mouse, rodent, monkey, ape and the like, and a "zeta stimulatory domain" or alternatively a "CD3-zeta stimulatory domain" or a "TCR-zeta stimulatory domain" is defined as the amino acid residues from the cytoplasmic domain of the zeta chain that are sufficient to functionally transmit an initial signal necessary for T cell activation. In one aspect the cytoplasmic domain of zeta comprises residues 52 through 164 of GenBank Acc. No. BAG36664.1 or the equivalent residues from a non-human species, e.g., mouse, rodent, monkey, ape and the like, that are functional orthologs thereof. In one aspect, the "zeta stimulatory domain" or a "CD3-zeta stimulatory domain" is the sequence provided as SEQ ID NO:9. In one aspect, the "zeta stimulatory domain" or a "CD3-zeta stimulatory domain" is the sequence provided as SEQ ID NO:10.

The term "costimulatory molecule" refers to the cognate binding partner on a T cell that specifically binds with a costimulatory ligand, thereby mediating a costimulatory response by the T cell, such as, but not limited to, proliferation. Costimulatory molecules are cell surface molecules other than antigen receptors or their ligands that are required for an efficient immune response. Costimulatory molecules include, but are not limited to an a MHC class I molecule, TNF receptor proteins, Immunoglobulin-like proteins, cytokine receptors, integrins, signaling lymphocytic activation molecules (SLAM proteins), activating NK cell receptors, BTLA, a Toll ligand receptor, OX40, CD2, CD7, CD27, CD28, CD30, CD40, CDS, ICAM-1, LFA-1 (CD11a/CD18), 4-1BB (CD137), B7-H3, CDS, ICAM-1, ICOS (CD278), GITR, BAFFR, LIGHT, HVEM (LIGHTR), KIRDS2, SLAMF7, NKp80 (KLRF1), NKp44, NKp30, NKp46, CD19, CD4, CD8alpha, CD8beta, IL2R beta, IL2R gamma, IL7R alpha, ITGA4, VLA1, CD49a, ITGA4, IA4, CD49D, ITGA6, VLA-6, CD49f, ITGAD, CD11d, ITGAE, CD103, ITGAL, CD11a, LFA-1, ITGAM, CD11b, ITGAX, CD11c, ITGB1, CD29, ITGB2, CD18, LFA-1, ITGB7, NKG2D, NKG2C, TNFR2, TRANCE/RANKL, DNAM1 (CD226), SLAMF4 (CD244, 2B4), CD84, CD96 (Tactile), CEACAM1, CRTAM, Ly9 (CD229), CD160 (BY55), PSGL1, CD100 (SEMA4D), CD69, SLAMF6 (NTB-A, Ly108), SLAM (SLAMF1, CD150, IPO-3), BLAME (SLAMF8), SELPLG (CD162), LTBR, LAT, GADS, SLP-76, PAG/Cbp, CD19a, and a ligand that specifically binds with CD83.

A costimulatory intracellular signaling domain refers to the intracellular portion of a costimulatory molecule. The intracellular signaling domain can comprise the entire intracellular portion, or the entire native intracellular signaling domain, of the molecule from which it is derived, or a functional fragment thereof.

The term "4-1BB" refers to a member of the TNFR superfamily with an amino acid sequence provided as GenBank Acc. No. AAA62478.2, or the equivalent residues from a non-human species, e.g., mouse, rodent, monkey, ape and the like; and a "4-1BB costimulatory domain" is defined as amino acid residues 214-255 of GenBank accno. AAA62478.2, or the equivalent residues from a non-human species, e.g., mouse, rodent, monkey, ape and the like. In one aspect, the "4-1BB costimulatory domain" is the sequence provided as SEQ ID NO:7 or the equivalent residues from a non-human species, e.g., mouse, rodent, monkey, ape and the like.

"Immune effector cell," as that term is used herein, refers to a cell that is involved in an immune response, e.g., in the promotion of an immune effector response. Examples of immune effector cells include T cells, e.g., alpha/beta T cells and gamma/delta T cells, B cells, natural killer (NK) cells, natural killer T (NKT) cells, mast cells, and myeloic-derived phagocytes.

"Immune effector function or immune effector response," as that term is used herein, refers to function or response, e.g., of an immune effector cell, that enhances or promotes an immune attack of a target cell. E.g., an immune effector function or response refers a property of a T or NK cell that promotes killing or the inhibition of growth or proliferation, of a target cell. In the case of a T cell, primary stimulation and co-stimulation are examples of immune effector function or response.

The term "effector function" refers to a specialized function of a cell. Effector function of a T cell, for example, may be cytolytic activity or helper activity including the secretion of cytokines.

The term "encoding" refers to the inherent property of specific sequences of nucleotides in a polynucleotide, such as a gene, a cDNA, or an mRNA, to serve as templates for synthesis of other polymers and macromolecules in biological processes having either a defined sequence of nucleotides (i.e., rRNA, tRNA and mRNA) or a defined sequence of amino acids and the biological properties resulting therefrom. Thus, a gene encodes a protein if transcription and translation of mRNA corresponding to that gene produces the protein in a cell or other biological system. Both the coding strand, the nucleotide sequence of which is identical to the mRNA sequence and is usually provided in sequence listings, and the non-coding strand, used as the template for transcription of a gene or cDNA, can be referred to as encoding the protein or other product of that gene or cDNA.

Unless otherwise specified, a "nucleotide sequence encoding an amino acid sequence" includes all nucleotide sequences that are degenerate versions of each other and that encode the same amino acid sequence. Nucleotide sequences that encode proteins and RNA may include introns.

The term "effective amount" or "therapeutically effective amount" are used interchangeably herein, and refer to an amount of a compound, formulation, material, or composition, as described herein effective to achieve a particular biological result. Such results may include, but are not limited to, the inhibition of virus infection as determined by any means suitable in the art.

As used herein "endogenous" refers to any material from or produced inside an organism, cell, tissue or system.

As used herein, the term "exogenous" refers to any material introduced from or produced outside an organism, cell, tissue or system.

The term "expression" as used herein is defined as the transcription and/or translation of a particular nucleotide sequence driven by its promoter.

The term "expression" refers to the transcription and/or translation of a particular nucleotide sequence driven by a promoter.

The term "transfer vector" refers to a composition of matter which comprises an isolated nucleic acid and which can be used to deliver the isolated nucleic acid to the interior of a cell. Numerous vectors are known in the art including, but not limited to, linear polynucleotides, polynucleotides associated with ionic or amphiphilic compounds, plasmids, and viruses. Thus, the term "transfer vector" includes an autonomously replicating plasmid or a virus. The term should also be construed to further include non-plasmid and non-viral compounds which facilitate transfer of nucleic acid into cells, such as, for example, a polylysine compound, liposome, and the like. Examples of viral transfer vectors include, but are not limited to, adenoviral vectors, adeno-associated virus vectors, retroviral vectors, lentiviral vectors, and the like.

"Expression vector" refers to a vector comprising a recombinant polynucleotide comprising expression control sequences operatively linked to a nucleotide sequence to be expressed. An expression vector comprises sufficient cis-acting elements for expression; other elements for expression can be supplied by the host cell or in an in vitro expression system. Expression vectors include all those known in the art, such as cosmids, plasmids (e.g., naked or contained in liposomes) and viruses (e.g., lentiviruses, retroviruses, adenoviruses, and adeno-associated viruses) that incorporate the recombinant polynucleotide.

The term "vector" as used herein refers to any vehicle that can be used to deliver and/or express a nucleic acid molecule. It can be a transfer vector or an expression vector as described herein.

The term "homologous" or "identity", as used herein, refers to the subunit sequence identity between two polymeric molecules, e.g., between two nucleic acid molecules, such as, two DNA molecules or two RNA molecules, or between two polypeptide molecules. When a subunit position in both of the two molecules is occupied by the same monomeric subunit; e.g., if a position in each of two DNA molecules is occupied by adenine, then they are homologous at that position. The homology between two sequences is a direct function of the number of matching or homologous positions; e.g., if half (e.g., five positions in a polymer ten subunits in length) of the positions in two sequences are homologous, the two sequences are 50% homologous; if 90% of the positions (e.g., 9 of 10), are matched or homologous, the two sequences are 90% homologous.

"Humanized" forms of non-human (e.g., murine) antibodies are chimeric immunoglobulins, immunoglobulin chains or fragments thereof (such as Fv, Fab, Fab', F(ab')2 or other antigen-binding subsequences of antibodies) which contain minimal sequence derived from non-human immunoglobulin. For the most part, humanized antibodies are human immunoglobulins (recipient antibody) in which residues from a complementary-determining region (CDR) of the recipient are replaced by residues from a CDR of a non-human species (donor antibody) such as mouse, rat or rabbit having the desired specificity, affinity, and capacity. In some instances, Fv framework region (FR) residues of the human immunoglobulin are replaced by corresponding non-human residues. Furthermore, humanized antibodies can comprise residues which are found neither in the recipient antibody nor in the imported CDR or framework sequences. These modifications are made to further refine and optimize antibody performance. In general, the humanized antibody will comprise substantially all of at least one, and typically two, variable domains, in which all or substantially all of the CDR regions correspond to those of a non-human immunoglobulin and all or substantially all of the FR regions are those of a human immunoglobulin sequence. The humanized antibody optimally also will comprise at least a portion of an immunoglobulin constant region (Fc), typically that of a human immunoglobulin. For further details, see Jones et al., Nature, 321: 522-525, 1986; Reichmann et al., Nature, 332: 323-329, 1988; Presta, Curr. Op. Struct. Biol., 2: 593-596, 1992.

"Fully human" refers to an immunoglobulin, such as an antibody or antibody fragment, where the whole molecule is of human origin or consists of an amino acid sequence identical to a human form of the antibody or immunoglobulin.

As used herein, an "instructional material" includes a publication, a recording, a diagram, or any other medium of expression which can be used to communicate the usefulness of the compositions and methods of the invention. The instructional material of the kit of the invention may, for example, be affixed to a container which contains the nucleic acid, peptide, and/or composition of the invention or be shipped together with a container which contains the nucleic acid, peptide, and/or composition. Alternatively, the instructional material may be shipped separately from the container with the intention that the instructional material and the compound be used cooperatively by the recipient.

The term "isolated" means altered or removed from the natural state. For example, a nucleic acid or a peptide naturally present in a living animal is not "isolated," but the same nucleic acid or peptide partially or completely separated from the coexisting materials of its natural state is "isolated." An isolated nucleic acid or protein can exist in substantially purified form, or can exist in a non-native environment such as, for example, a host cell.

In the context of the present invention, the following abbreviations for the commonly occurring nucleic acid bases are used. "A" refers to adenosine, "C" refers to cytosine, "G" refers to guanosine, "T" refers to thymidine, and "U" refers to uridine.

Unless otherwise specified, a "nucleotide sequence encoding an amino acid sequence" includes all nucleotide sequences that are degenerate versions of each other and that encode the same amino acid sequence. The phrase nucleotide sequence that encodes a protein or an RNA may also include introns to the extent that the nucleotide sequence encoding the protein may in some version contain an intron(s).

A "lentivirus" as used herein refers to a genus of the Retroviridae family. Lentiviruses are unique among the retroviruses in being able to infect non-dividing cells; they can deliver a significant amount of genetic information into the DNA of the host cell, so they are one of the most efficient methods of a gene delivery vector. HIV, SIV, and FIV are all examples of lentiviruses. Vectors derived from lentiviruses offer the means to achieve significant levels of gene transfer in vivo.

The term "lentiviral vector" refers to a vector derived from at least a portion of a lentivirus genome, including especially a self-inactivating lentiviral vector as provided in Milone et al., Mol. Ther. 17(8): 1453-1464 (2009). Other examples of lentivirus vectors that may be used in the clinic, include but are not limited to, e.g., the LENTIVECTOR® gene delivery technology from Oxford BioMedica, the LENTIMAX™ vector system from Lentigen and the like. Nonclinical types of lentiviral vectors are also available and would be known to one skilled in the art.

The term "flexible polypeptide linker" or "linker" as used in the context of a scFv refers to a peptide linker that consists of amino acids such as glycine and/or serine residues used alone or in combination, to link variable heavy and variable light chain regions together. In one embodiment, the flexible polypeptide linker is a Gly/Ser linker and comprises the amino acid sequence (Gly-Gly-Gly-Ser)n (SEQ ID NO: 38), where n is a positive integer equal to or greater than 1. For example, n=1, n=2, n=3. n=4, n=5 and n=6, n=7, n=8, n=9 and n=10 In one embodiment, the flexible polypeptide linkers include, but are not limited to, (Gly4 Ser)4 (SEQ ID NO:27) or (Gly4 Ser)3 (SEQ ID NO:28). In another embodiment, the linkers include multiple repeats of (Gly2Ser), (GlySer) or (Gly3Ser) (SEQ ID NO:29). Also included within the scope of the invention are linkers described in WO2012/138475, incorporated herein by reference).

"NK cell immune-function receptor" or "NKR", as that term is used herein, refers to an endogenous naturally occurring transmembrane protein expressed in NK cells, which can engage with a ligand on an antigen presenting cell and modulate an NK cell immune-function response, e.g., it can modulate the cytolytic activity or cytokine secretion of the NK cell. The NKR can contribute to activation (an activating NKR, or actNKR), or inhibition (an inhibitory NKR, or inhNKR). Typically, an NKR comprises an extracellular ligand-binding domain (ECD), a transmembrane domain (TM) and an intracellular cytoplasmic domain (ICD). NKRs include the Killer Immunoglobulin-like Receptor (KIR) family of receptors such as KIR2DS2, the NK cell receptor (NCR) receptor family of receptors such as NKp46 (NCR1), the signaling lymphocyte activation receptor (SLAM) family (SLAMF) of receptors such as 2B4, and the Fc-binding receptors such as the IgG-binding receptor, CD16 (FcγRIII). Examples of NK cell immune-function responses modulated by NKRs comprise target cell killing (often referred to as cytotoxicity or cytolysis), cytokine secretion and/or proliferation. Typically, an NKR suitable for use in the methods and compositions described herein is a human NKR, (or hNKR). In an embodiment, the Ly49 receptor family in Mus musculus, which emerged by convergent evolution to provide the same function as a KIR in murine NK and T cells, is also included.

The term "operably linked" refers to functional linkage between a regulatory sequence and a heterologous nucleic acid sequence resulting in expression of the latter. For example, a first nucleic acid sequence is operably linked with a second nucleic acid sequence when the first nucleic acid sequence is placed in a functional relationship with the second nucleic acid sequence. For instance, a promoter is operably linked to a coding sequence if the promoter affects the transcription or expression of the coding sequence. Generally, operably linked DNA sequences are contiguous and, where necessary to join two protein coding regions, in the same reading frame.

"Parenteral" administration of an immunogenic composition includes, e.g., subcutaneous (s.c.), intravenous (i.v.), intramuscular (i.m.), or intrasternal injection, or infusion techniques.

The term "nucleic acid", nucleic acid molecule", or "polynucleotide" as used interchangeably herein is defined as a chain of nucleotides. Furthermore, nucleic acids are polymers of nucleotides. Thus, nucleic acids and polynucleotides as used herein are interchangeable. One skilled in the art has the general knowledge that nucleic acids are polynucleotides, which can be hydrolyzed into the monomeric "nucleotides." The monomeric nucleotides can be hydrolyzed into nucleosides. As used herein polynucleotides include, but are not limited to, all nucleic acid sequences which are obtained by any means available in the art, including, without limitation, recombinant means, i.e., the cloning of nucleic acid sequences from a recombinant library or a cell genome, using ordinary cloning technology and PCR™, and the like, and by synthetic means. In embodiments, the nucleic acids herein are deoxyribonucleic acid (DNA) or ribonucleic acid (RNA), or a combination of a DNA or RNA thereof, and polymers thereof in either single- or double-stranded form. The term "nucleic acid" includes a gene, cDNA or an mRNA. In one embodiment, the nucleic acid molecule is synthetic (e.g., chemically synthesized) or recombinant. Unless specifically limited, the term encompasses nucleic acids containing analogues or derivatives of natural nucleotides that have similar binding properties as the reference nucleic acid and are metabolized in a manner similar to naturally occurring nucleotides. Unless otherwise indicated, a particular nucleic acid sequence also implicitly encompasses conservatively modified variants thereof (e.g., degenerate codon substitutions), alleles, orthologs, SNPs, and complementary sequences as well as the sequence explicitly indicated. Specifically, degenerate codon substitutions may be achieved by generating sequences in which the third position of one or more selected (or all) codons is substituted with mixed-base and/or deoxyinosine residues (Batzer et al., Nucleic Acid Res. 19:5081 (1991); Ohtsuka et al., J. Biol. Chem. 260: 2605-2608 (1985); and Rossolini et al., Mol. Cell. Probes 8:91-98 (1994)).

As used herein, the terms "peptide," "polypeptide," and "protein" are used interchangeably, and refer to a compound comprised of amino acid residues covalently linked by peptide bonds. A protein or peptide must contain at least two amino acids, and no limitation is placed on the maximum number of amino acids that can comprise a protein's or peptide's sequence. Polypeptides include any peptide or protein comprising two or more amino acids joined to each other by peptide bonds. As used herein, the term refers to both short chains, which also commonly are referred to in the art as peptides, oligopeptides and oligomers, for example, and to longer chains, which generally are referred to in the art as proteins, of which there are many types. "Polypeptides" include, for example, biologically active fragments, substantially homologous polypeptides, oligopeptides, homodimers, heterodimers, variants of polypeptides, modified polypeptides, derivatives, analogs, fusion proteins, among others. The polypeptides include natural peptides, recombinant peptides, synthetic peptides, or a combination thereof.

The term "promoter" as used herein is defined as a DNA sequence recognized by the synthetic machinery of the cell, or introduced synthetic machinery, required to initiate the specific transcription of a polynucleotide sequence.

As used herein, the term "promoter/regulatory sequence" means a nucleic acid sequence which is required for expression of a gene product operably linked to the promoter/regulatory sequence. In some instances, this sequence may be the core promoter sequence and in other instances, this sequence may also include an enhancer sequence and other regulatory elements which are required for expression of the gene product. The promoter/regulatory sequence may, for example, be one which expresses the gene product in a tissue specific manner.

An "inducible" promoter is a nucleotide sequence which, when operably linked with a polynucleotide which encodes or specifies a gene product, causes the gene product to be produced in a cell substantially only when an inducer which corresponds to the promoter is present in the cell.

A "tissue-specific" promoter is a nucleotide sequence which, when operably linked with a polynucleotide encodes or specified by a gene, causes the gene product to be produced in a cell substantially only if the cell is a cell of the tissue type A "signal transduction pathway" refers to the biochemical relationship between a variety of signal transduction molecules that play a role in the transmission of a signal from one portion of a cell to another portion of a cell. The phrase "cell surface receptor" includes molecules and complexes of molecules capable of receiving a signal and transmitting signal across the membrane of a cell.

The term "subject" is intended to include living organisms in which an immune response can be elicited (e.g., mammals).

As used herein, a "substantially purified" cell is a cell that is essentially free of other cell types. A substantially purified cell also refers to a cell which has been separated from other cell types with which it is normally associated in its naturally occurring state. In some instances, a population of substantially purified cells refers to a homogenous population of cells. In other instances, this term refers simply to cell that have been separated from the cells with which they are naturally associated in their natural state. In some embodiments, the cells are cultured in vitro. In other embodiments, the cells are not cultured in vitro.

As used herein, a 5' cap (also termed an RNA cap, an RNA 7-methylguanosine cap or an RNA m7G cap) is a modified guanine nucleotide that has been added to the "front" or 5' end of a eukaryotic messenger RNA shortly after the start of transcription. The 5' cap consists of a terminal group which is linked to the first transcribed nucleotide. Its presence is critical for recognition by the ribosome and protection from RNases. Cap addition is coupled to transcription, and occurs co-transcriptionally, such that each influences the other. Shortly after the start of transcription, the 5' end of the mRNA being synthesized is bound by a cap-synthesizing complex associated with RNA polymerase. This enzymatic complex catalyzes the chemical reactions that are required for mRNA capping. Synthesis proceeds as a multi-step biochemical reaction. The capping moiety can be modified to modulate functionality of mRNA such as its stability or efficiency of translation.

As used herein, "in vitro transcribed RNA" refers to RNA, preferably mRNA, that has been synthesized in vitro. Generally, the in vitro transcribed RNA is generated from an in vitro transcription vector. The in vitro transcription vector comprises a template that is used to generate the in vitro transcribed RNA.

As used herein, a "poly(A)" is a series of adenosines attached by polyadenylation to the mRNA. In the preferred embodiment of a construct for transient expression, the polyA is between 50 and 5000 (SEQ ID NO: 30), preferably greater than 64, more preferably greater than 100, most preferably greater than 300 or 400. poly(A) sequences can be modified chemically or enzymatically to modulate mRNA functionality such as localization, stability or efficiency of translation.

As used herein, "polyadenylation" refers to the covalent linkage of a polyadenylyl moiety, or its modified variant, to a messenger RNA molecule. In eukaryotic organisms, most messenger RNA (mRNA) molecules are polyadenylated at the 3' end. The 3' poly(A) tail is a long sequence of adenine nucleotides (often several hundred) added to the pre-mRNA through the action of an enzyme, polyadenylate polymerase. In higher eukaryotes, the poly(A) tail is added onto transcripts that contain a specific sequence, the polyadenylation signal. The poly(A) tail and the protein bound to it aid in protecting mRNA from degradation by exonucleases. Polyadenylation is also important for transcription termination, export of the mRNA from the nucleus, and translation. Polyadenylation occurs in the nucleus immediately after transcription of DNA into RNA, but additionally can also occur later in the cytoplasm. After transcription has been terminated, the mRNA chain is cleaved through the action of an endonuclease complex associated with RNA polymerase. The cleavage site is usually characterized by the presence of the base sequence AAUAAA near the cleavage site. After the mRNA has been cleaved, adenosine residues are added to the free 3' end at the cleavage site.

As used herein, "transient" refers to expression of a non-integrated transgene for a period of hours, days or weeks, wherein the period of time of expression is less than the period of time for expression of the gene if integrated into the genome or contained within a stable plasmid replicon in the host cell.

The term "therapeutic" as used herein means a treatment and/or prophylaxis. A therapeutic effect is obtained by suppression, remission, or eradication of a disease state.

The term "transfected" or "transformed" or "transduced" as used herein refers to a process by which exogenous nucleic acid is transferred or introduced into the host cell. A "transfected" or "transformed" or "transduced" cell is one which has been transfected, transformed or transduced with exogenous nucleic acid. The cell includes the primary subject cell and its progeny.

As used herein, the terms "treat", "treatment" and "treating" refer to the reduction or amelioration of the progression, severity and/or duration of a proliferative disorder, or the amelioration of one or more symptoms (preferably, one or more discernible symptoms) of a proliferative disorder resulting from the administration of one or more therapies (e.g., one or more therapeutic agents such as a CAR of the invention). In specific embodiments, the terms "treat", "treatment" and "treating" refer to the amelioration of at least one measurable physical parameter of a proliferative disorder, such as growth of a tumor, not necessarily discernible by the patient. In other embodiments the terms "treat", "treatment" and "treating"-refer to the inhibition of the progression of a proliferative disorder, either physically by, e.g., stabilization of a discernible symptom, physiologically by, e.g., stabilization of a physical parameter, or both. In other embodiments the terms "treat", "treatment" and "treating" refer to the reduction or stabilization of tumor size or cancerous cell count.

The term "prophylaxis" as used herein means the prevention of or protective treatment for a disease or disease state.

The term "tumor antigen" as used herein refers to a molecule (typically a protein, carbohydrate or lipid) that is expressed on the surface of a cancer or tumor cell, either entirely or as a fragment (e.g., MHC/peptide), and which is useful for the preferential targeting of a pharmacological agent to the cancer or tumor cell. In some embodiments, a tumor antigen is a marker expressed by both normal cells and cancer cells, e.g., a lineage marker, e.g., CD19 or CD123 on B cells. In some embodiments, a tumor antigen is a cell surface molecule that is overexpressed in a cancer cell in comparison to a normal cell, for instance, 1-fold over expression, 2-fold overexpression, 3-fold overexpression or more in comparison to a normal cell. In some embodiments, a tumor antigen is a cell surface molecule that is inappropriately synthesized in the cancer cell, for instance, a molecule that contains deletions, additions or mutations in comparison to the molecule expressed on a normal cell. In some embodiments, a tumor antigen will be expressed exclusively on the cell surface of a cancer cell, entirely or as a fragment (e.g., MHC/peptide), and not synthesized or expressed on the surface of a normal cell.

In some embodiments, the CARs of the present invention includes CARs comprising an antigen binding domain (e.g., antibody or antibody fragment) that binds to a MHC presented peptide. Normally, peptides derived from endogenous proteins fill the pockets of Major histocompatibility complex (MHC) class I molecules, and are recognized by T cell receptors (TCRs) on CD8+ T lymphocytes. The MHC class I complexes are constitutively expressed by all nucleated cells. In cancer, virus-specific and/or tumor-specific peptide/MHC complexes represent a unique class of cell surface targets for immunotherapy. TCR-like antibodies targeting peptides derived from viral or tumor antigens in the context of human leukocyte antigen (HLA)-A1 or HLA-A2 have been described (see, e.g., Sastry et al., J Virol. 2011 85(5):1935-1942; Sergeeva et al., Blood, 2011 117(16): 4262-4272; Verma et al., J Immunol 2010 184(4):2156-2165; Willemsen et al., Gene Ther 2001 8(21):1601-1608; Dao et al., Sci Transl Med 2013 5(176):176ra33; Tassev et al., Cancer Gene Ther 2012 19(2):84-100). For example, TCR-like antibody can be identified from screening a library, such as a human scFv phage displayed library.

The phrase "under transcriptional control" or "operatively linked" as used herein means that the promoter is in the correct location and orientation in relation to a polynucleotide to control the initiation of transcription by RNA polymerase and expression of the polynucleotide.

A "vector" is a composition of matter which comprises an isolated nucleic acid and which can be used to deliver the isolated nucleic acid to the interior of a cell. Numerous vectors are known in the art including, but not limited to, linear polynucleotides, polynucleotides associated with ionic or amphiphilic compounds, plasmids, and viruses. Thus, the term "vector" includes an autonomously replicating plasmid or a virus. The term should also be construed to include non-plasmid and non-viral compounds which facilitate transfer of nucleic acid into cells, such as, for example, polylysine compounds, liposomes, and the like. Examples of viral vectors include, but are not limited to, adenoviral vectors, adeno-associated virus vectors, retroviral vectors, lentiviral vectors, and the like.

By the term "specifically binds," as used herein, is meant an antibody, or a ligand, which recognizes and binds with a cognate binding partner protein present in a sample, but which antibody or ligand does not substantially recognize or bind other molecules in the sample.

By the term "stimulation," is meant a primary response induced by binding of a stimulatory molecule with its cognate ligand thereby mediating a signal transduction event, such as, but not limited to, signal transduction via the appropriate NK receptor.

"Xenogeneic" refers to a graft derived from an animal of a different species.

The term "specifically binds," refers to an antibody, or a ligand, which recognizes and binds with a cognate binding partner (e.g., a stimulatory and/or costimulatory molecule present on a T cell) protein present in a sample, but which antibody or ligand does not substantially recognize or bind other molecules in the sample.

"Regulatable chimeric antigen receptor (RCAR)," as used herein, refers to a set of polypeptides, typically two in the simplest embodiments, which when in an immune effector cell, provides the cell with specificity for a target cell, typically a cancer cell, and with regulatable intracellular signal generation. In some embodiments, an RCAR comprises at least an extracellular antigen binding domain, a transmembrane and a cytoplasmic signaling domain (also referred to herein as "an intracellular signaling domain") comprising a functional signaling domain derived from a stimulatory molecule and/or costimulatory molecule as defined herein in the context of a CAR molecule. In some embodiments, the set of polypeptides in the RCAR are not contiguous with each other, e.g., are in different polypeptide chains. In some embodiments, the RCAR includes a dimerization switch that, upon the presence of a dimerization molecule, can couple the polypeptides to one another, e.g., can couple an antigen binding domain to an intracellular signaling domain. In some embodiments, the RCAR is expressed in a cell (e.g., an immune effector cell) as described herein, e.g., an RCAR-expressing cell (also referred to herein as "RCARX cell"). In an embodiment the RCARX cell is a T cell, and is referred to as a RCART cell. In an embodiment the RCARX cell is an NK cell, and is referred to as a RCARN cell. The RCAR can provide the RCAR-expressing cell with specificity for a target cell, typically a cancer cell, and with regulatable intracellular signal generation or proliferation, which can optimize an immune effector property of the RCAR-expressing cell. In embodiments, an RCAR cell relies at least in part, on an antigen binding domain to provide specificity to a target cell that comprises the antigen bound by the antigen binding domain.

"Membrane anchor" or "membrane tethering domain", as that term is used herein, refers to a polypeptide or moiety, e.g., a myristoyl group, sufficient to anchor an extracellular or intracellular domain to the plasma membrane.

"Switch domain," as that term is used herein, e.g., when referring to an RCAR, refers to an entity, typically a polypeptide-based entity, that, in the presence of a dimerization molecule, associates with another switch domain. The association results in a functional coupling of a first entity linked to, e.g., fused to, a first switch domain, and a second entity linked to, e.g., fused to, a second switch domain. A first and second switch domain are collectively referred to as a dimerization switch. In embodiments, the first and second switch domains are the same as one another, e.g., they are polypeptides having the same primary amino acid sequence, and are referred to collectively as a homodimerization switch. In embodiments, the first and second switch domains are different from one another, e.g., they are polypeptides having different primary amino acid sequences, and are referred to collectively as a heterodimerization switch. In embodiments, the switch is intracellular. In embodiments, the switch is extracellular. In embodiments, the switch domain is a polypeptide-based entity, e.g., FKBP or FRB-based, and the dimerization molecule is small molecule, e.g., a rapalogue. In embodiments, the switch domain is a polypeptide-based entity, e.g., an scFv that binds a myc peptide, and the dimerization molecule is a polypeptide, a fragment thereof, or a multimer of a polypeptide, e.g., a myc ligand or multimers of a myc ligand that bind to one or more myc scFvs. In embodiments, the switch domain is a polypeptide-based entity, e.g., myc receptor, and the dimerization molecule is an antibody or fragments thereof, e.g., myc antibody.

"Dimerization molecule," as that term is used herein, e.g., when referring to an RCAR, refers to a molecule that promotes the association of a first switch domain with a second switch domain. In embodiments, the dimerization molecule does not naturally occur in the subject, or does not occur in concentrations that would result in significant dimerization. In embodiments, the dimerization molecule is a small molecule, e.g., rapamycin or a rapalogue, e.g., RAD001.

The term "bioequivalent" refers to an amount of an agent other than the reference compound (e.g., RAD001), required to produce an effect equivalent to the effect produced by the reference dose or reference amount of the reference compound (e.g., RAD001). In an embodiment the effect is the level of mTOR inhibition, e.g., as measured by P70 S6 kinase inhibition, e.g., as evaluated in an in vivo or in vitro assay, e.g., as measured by an assay described herein, e.g., the Boulay assay, or measurement of phosphorylated S6 levels by western blot. In an embodiment, the effect is alteration of the ratio of PD-1 positive/PD-1 negative immune effector cells, e.g., T cells or NK cells, as measured by cell sorting. In an embodiment a bioequivalent amount or dose of an mTOR inhibitor is the amount or dose that achieves the same level of P70 S6 kinase inhibition as does the reference dose or reference amount of a reference compound. In an embodiment, a bioequivalent amount or dose of an mTOR inhibitor is the amount or dose that achieves the same level of alteration in the ratio of PD-1 positive/PD-1 negative immune effector cells, e.g., T cells or NK cells as does the reference dose or reference amount of a reference compound.

The term "low, immune enhancing, dose" when used in conjunction with an mTOR inhibitor, e.g., an allosteric mTOR inhibitor, e.g., RAD001 or rapamycin, or a catalytic mTOR inhibitor, refers to a dose of mTOR inhibitor that partially, but not fully, inhibits mTOR activity, e.g., as measured by the inhibition of P70 S6 kinase activity. Methods for evaluating mTOR activity, e.g., by inhibition of P70 S6 kinase, are discussed herein. The dose is insufficient to result in complete immune suppression but is sufficient to enhance the immune response. In an embodiment, the low, immune enhancing, dose of mTOR inhibitor results in a decrease in the number of PD-1 positive immune effector cells, e.g., T cells or NK cells, and/or an increase in the number of PD-1 negative immune effector cells, e.g., T cells or NK cells, or an increase in the ratio of PD-1 negative T cells/PD-1 positive immune effector cells, e.g., T cells or NK cells.

In an embodiment, the low, immune enhancing, dose of mTOR inhibitor results in an increase in the number of naive immune effector cells, e.g., T cells or NK cells. In an embodiment, the low, immune enhancing, dose of mTOR inhibitor results in one or more of the following:
　　an increase in the expression of one or more of the following markers: $CD62L^{high}$, $CD127^{high}$, $CD27^+$, and BCL2, e.g., on memory T cells, e.g., memory T cell precursors;

a decrease in the expression of KLRG1, e.g., on memory T cells, e.g., memory T cell precursors; and an increase in the number of memory T cell precursors, e.g., cells with any one or combination of the following characteristics: increased CD62L$^{high}$, increased CD127$^{high}$, increased CD27$^+$, decreased KLRG1, and increased BCL2;

wherein any of the changes described above occurs, e.g., at least transiently, e.g., as compared to a non-treated subject.

"Refractory" as used herein refers to a disease, e.g., cancer, that does not respond to a treatment. In embodiments, a refractory cancer can be resistant to a treatment before or at the beginning of the treatment. In other embodiments, the refractory cancer can become resistant during a treatment. A refractory cancer is also called a resistant cancer.

"Relapsed" or "relapse" as used herein refers to the return or reappearance of a disease (e.g., cancer) or the signs and symptoms of a disease such as cancer after a period of improvement or responsiveness, e.g., after prior treatment of a therapy, e.g., cancer therapy. The initial period of responsiveness may involve the level of cancer cells falling below a certain threshold, e.g., below 20%, 1%, 10%, 5%, 4%, 3%, 2%, or 1%. The reappearance may involve the level of cancer cells rising above a certain threshold, e.g., above 20%, 1%, 10%, 5%, 4%, 3%, 2%, or 1%. For example, e.g., in the context of B-ALL, the reappearance may involve, e.g., a reappearance of blasts in the blood, bone marrow (>5%), or any extramedullary site, after a complete response. A complete response, in this context, may involve <5% BM blast. More generally, in an embodiment, a response (e.g., complete response or partial response) can involve the absence of detectable MRD (minimal residual disease). In an embodiment, the initial period of responsiveness lasts at least 1, 2, 3, 4, 5, or 6 days; at least 1, 2, 3, or 4 weeks; at least 1, 2, 3, 4, 6, 8, 10, or 12 months; or at least 1, 2, 3, 4, or 5 years.

In some embodiments, a therapy that includes a CD19 inhibitor, e.g., a CD19 CAR therapy, may relapse or be refractory to treatment. The relapse or resistance can be caused by CD19 loss (e.g., an antigen loss mutation) or other CD19 alteration that reduces the level of CD19 (e.g., caused by clonal selection of CD19-negative clones). A cancer that harbors such CD19 loss or alteration is referred to herein as a "CD19-negative cancer" or a "CD19-negative relapsed cancer"). It shall be understood that a CD19-negative cancer need not have 100% loss of CD19, but a sufficient reduction to reduce the effectiveness of a CD19 therapy such that the cancer relapses or becomes refractory. In some embodiments, a CD19-negative cancer results from a CD19 CAR therapy.

Ranges: throughout this disclosure, various aspects of the invention can be presented in a range format. It should be understood that the description in range format is merely for convenience and brevity and should not be construed as an inflexible limitation on the scope of the invention. Accordingly, the description of a range should be considered to have specifically disclosed all the possible subranges as well as individual numerical values within that range. For example, description of a range such as from 1 to 6 should be considered to have specifically disclosed subranges such as from 1 to 3, from 1 to 4, from 1 to 5, from 2 to 4, from 2 to 6, from 3 to 6 etc., as well as individual numbers within that range, for example, 1, 2, 2.7, 3, 4, 5, 5.3, and 6. This applies regardless of the breadth of the range.

NKR-CARs

Disclosed herein are compositions and methods for regulating the specificity and activity of cytotoxic cells, e.g., T cells or NK cells, e.g., with a non-naturally occurring chimeric antigen receptor (CAR). In an embodiment the CAR is an NKR-CAR. A NKR-CAR is a CAR which shares functional and structural properties with a NK cell immune-function receptor (or NKR). NKRs and NKR-CARs are described herein, e.g., in the section below. As is discussed below, a variety of NKRs can serve as the basis for an NKR-CAR.

NK Cell Immune-Function Receptors (NKRs) and NK Cells

As discussed herein, NK cell immune-function receptor (or NKR) refers to an endogenous naturally occurring transmembrane protein expressed in NK cells, which can engage with a ligand on an antigen presenting cell and modulate an NK cell immune-function response, e.g., it can modulate the cytolytic activity or cytokine secretion of the NK cell.

NK cells are mononuclear cells that develop in the bone marrow from lymphoid progenitors, and morphological features and biological properties typically include the expression of the cluster determinants (CDs) CD16, CD56, and/or CD57; the absence of the alpha/beta or gamma/delta TCR complex on the cell surface; the ability to bind to and kill target cells that fail to express "self" major histocompatibility complex (MHC)/human leukocyte antigen (HLA) proteins; and the ability to kill tumor cells or other diseased cells that express ligands for activating NK receptors. NK cells are characterized by their ability to bind and kill several types of tumor cell lines without the need for prior immunization or activation. NK cells can also release soluble proteins and cytokines that exert a regulatory effect on the immune system; and can undergo multiple rounds of cell division and produce daughter cells with similar biologic properties as the parent cell. Upon activation by interferons and/or cytokines, NK cells mediate the lysis of tumor cells and of cells infected with intracellular pathogens by mechanisms that require direct, physical contacts between the NK cell and the target cell. Lysis of target cells involves the release of cytotoxic granules from the NK cell onto the surface of the bound target, and effector proteins such as perforin and granzyme B that penetrate the target plasma membrane and induce apoptosis or programmed cell death. Normal, healthy cells are protected from lysis by NK cells. NK cell activity is regulated by a complex mechanism that involves both stimulating and inhibitory signals.

Briefly, the lytic activity of NK cells is regulated by various cell surface receptors that transduce either positive or negative intracellular signals upon interaction with ligands on the target cell. The balance between positive and negative signals transmitted via these receptors determines whether or not a target cell is lysed (killed) by a NK cell. NK cell stimulatory signals can be mediated by Natural Cytotoxicity Receptors (NCR) such as NKp30, NKp44, and NKp46; as well as NKG2C receptors, NKG2D receptors, certain activating killer cell immunoglobulin-like receptors (KIRs), and other activating NK receptors (Lanier, Annual Review of Immunology 2005; 23:225-74). NK cell inhibitory signals can be mediated by receptors like Ly49, CD94/NKG2A, as well as certain inhibitory KIRs, which recognize major histocompatibility complex (MHC) class I molecules (Karre et al., Nature 1986; 319:675-8; Ohlen et al, Science 1989; 246:666-8). These inhibitory receptors bind to polymorphic determinants of MHC class I molecules (including HLA class I) present on other cells and inhibit NK cell-mediated lysis.

KIR-CARs

Disclosed herein is a chimeric antigen receptor (CAR) molecule comprising an antigen binding domain and a killer cell immunoglobulin-like receptor domain (KIR-CAR). In one embodiment, the KIR-CAR of the invention is expressed on the surface of an immune effector cell, e.g., a T cell or a NK cell.

KIR-CAR Based NKCARs

KIRs, referred to as killer cell immunoglobulin-like receptors, have been characterized in humans and non-human primates, and are polymorphic type 1 trans-membrane molecules present on certain subsets of lymphocytes, including NK cells and some T cells. KIRs interact with determinants in the alpha 1 and 2 domains of the MHC class I molecules and, as described elsewhere herein, distinct KIRs are either stimulatory or inhibitory for NK cells.

NKR-CARs described herein include KIR-CARs, which share functional and structural properties with KIRs.

KIRs are a family of cell surface proteins found on NK cells. They regulate the killing function of these cells by interacting with MHC class I molecules, which are expressed on all cell types. This interaction allows them to detect virally infected cells or tumor cells. Most KIRs are inhibitory, meaning that their recognition of MHC suppresses the cytotoxic activity of the NK cell that expresses them. Only a limited number of KIRs have the ability to activate cells.

The KIR gene family have at least 15 gene loci (KIR2DL1, KIR2DL2/L3, KIR2DL4, KIR2DL5A, KIR2DL5B, KIR2DS1, KIR2DS2, KIR2DS3, KIR2DS4, KIR2DS5, KIR3DL1/S1, KIR3DL2, KIR3DL3 and two pseudogenes, KIR2DP1 and KIR3DP1) encoded within a 100-200 Kb region of the Leukocyte Receptor Complex (LRC) located on chromosome 19 (19q13.4). The LRC constitutes a large, 1 Mb, and dense cluster of rapidly evolving immune genes which contains genes encoding other cell surface molecules with distinctive Ig-like extra-cellular domains. In addition, the extended LRC contains genes encoding the transmembrane adaptor molecules DAP10 and DAP12.

KIR genes vary in length from 4 to 16 Kb (full genomic sequence) and can contain four to nine exons. KIR genes are classified as belonging to one of three groups according to their structural features: (1) Type I KIR2D genes, which encode two extra-cellular domain proteins with a D1 and D2 conformation; (2) The structurally divergent Type II KIR2D genes which encode two extra-cellular domain proteins with a D0 and D2 conformation; and finally (3) KIR3D genes encoding proteins with three extra-cellular Ig-like domains (D0, D1 and D2).

Type I KIR2D genes, which include the pseudogene KIR2DP1 as well as KIR2DL1-3 and KIR2DS1-5 genes, possess eight exons as well as a pseudoexon 3 sequence. This pseudoexon is inactivated in Type I KIR2D. In some cases this is due to a nucleotide substitution located on the intron 2-exon 3 splice-site where its nucleotide sequence exhibits a high-degree of identity to KIR3D exon 3 sequences and possesses a characteristic three base pair deletion. In other cases a premature stop codon initiates differential splicing of exon 3. Within the Type I KIR2D group of genes, KIR2DL1 and KIR2DL2 share a common deletion in exon 7 distinguishing them from all other KIR in this exon, which results in a shorter exon 7 sequence. Similarly, within Type I KIR2D, KIR2DL1-3 differ from KIR2DS1-5 only in the length of their cytoplasmic tail encoding region in exon 9. The KIR2DP1 pseudogene structure differs from that of KIR2DL1-3 in that the former has a shorter exon 4 sequence, due to a single base pair deletion.

Type II KIR2D genes include KIR2DL4 and KIR2DL5. Unlike KIR3D and Type I KIR2D, Type II KIR2D characteristically have deleted the region corresponding to exon 4 in all other KIR. Additionally, Type II KIR2D genes differ from Type I KIR2D genes in that the former possess a translated exon 3, while Type I KIR2D genes have an untranslated pseudoexon 3 sequence in its place. Within the Type II KIR2D genes, KIR2DL4 is further differentiated from KIR2DL5 (as well as from other KIR genes) by the length of its exon 1 sequence. In KIR2DL4, exon 1 was found to be six nucleotides longer and to possess an initiation codon different from those present in the other KIR genes. This initiation codon is in better agreement with the 'Kozak transcription initiation consensus sequence' than the second potential initiation codon in KIR2DL4 that corresponds to the initiation codon present in other KIR genes.

KIR3D genes possess nine exons and include the structurally related KIR3DL1, KIR3DS1, KIR3DL2 and KIR3DL3 genes. KIR3DL2 nucleotide sequences are the longest of all KIR genes and span 16,256 bp in full genomic sequences and 1,368 bp in cDNA. Within the KIR3D group, the four KIR genes differ in the length of the region encoding the cytoplasmic tail in exon 9. The length of the cytoplasmic tail of KIR proteins can vary from 14 amino acid residues long (in some KIR3DS1 alleles) to 108 amino acid residues long (in KIR2DL4 proteins). Additionally, KIR3DS1 differs from KIR3DL1 or KIR3DL2 in that the former has a shorter exon 8 sequence. KIR3DL3 differs from other KIR sequences in that it completely lacks exon 6. The most extreme KIR gene structure difference observed was that of KIR3DP1. This gene fragment completely lacks exons 6 through 9, and occasionally also exon 2. The remaining portions of the gene which are present (exon 1, 3, 4 and 5) share a high level of sequence identity to other KIR3D sequences, in particular to KIR3DL3 sequences.

KIR proteins possess characteristic Ig-like domains on their extracellular regions, which in some KIR proteins are involved in HLA class I ligand binding. They also possess transmembrane and cytoplasmic regions which are functionally relevant as they define the type of signal which is transduced to the NK cell. KIR proteins can have two or three Ig-like domains (hence KIR2D or KIR3D) as well as short or long cytoplasmic tails (represented as KIR2DS or KIR2DL). Two domain KIR proteins are subdivided into two groups depending on the origin of the membrane distal Ig-like domains present. Type I KIR2D proteins (KIR2DL1, KIR2DL2, KIR2DL3, KIR2DS1, KIR2DS2, KIR2DS3, KIR2DS4 and KIR2DS5) possess a membrane-distal Ig-like domain similar in origin to the KIR3D D1 Ig-like domain but lack a D0 domain. This D1 Ig-like domain is encoded mainly by the fourth exon of the corresponding KIR genes. The Type II KIR2D proteins, KIR2DL4 and KIR2DL5, possess a membrane-distal Ig-like domain of similar sequence to the D0 domain present in KIR3D proteins, however, Type II KIR2D lack a D1 domain. Long cytoplasmic tails usually contain two Immune Tyrosine-based Inhibitory Motifs (ITIM) which transduce inhibitory signals to the NK cell. Short cytoplasmic tails possess a positively charged amino acid residue in their transmembrane region which allows them to associate with a DAP12 signaling molecule capable of generating an activation signal Exceptions to this is KIR2DL4, which contains only one N-terminus ITIM. In addition, KIR2DL4 also possesses a charged residue (arginine) in its transmembrane domain, a feature which allows this receptor to elicit both inhibitory and activating signals. KIR control the response of human NK cells by delivering inhibitory or activating signals upon recognition of MHC class I ligands on the surface of potential target cells.

KIR proteins vary in length from 306 to 456 amino acid residues. Although the differences in protein length are mostly the consequence of the number of Ig-like domains present, cytoplasmic region length diversity is also an influencing factor. The leader peptide of most KIR proteins is 21 amino acid residues long. However, the presence of a different initiation codon generates a correspondingly longer leader peptide in KIR2DL4 proteins.

The D0 Ig-like domain present in Type II KIR2D proteins and KIR3D proteins is approximately 96 amino acid residues in length. The D1 domain of Type I KIR2D and of KIR3D proteins is 102 amino acid residues long, while the D2 domain of all KIR proteins is 98 amino acid residues long. The length of the stem region varies from the 24 amino acid residues present in most KIR proteins, to only seven amino acid residues in the divergent KIR3DL3 protein. The transmembrane region is 20 amino acid residues long for most KIR proteins, but one residue shorter on KIR2DL1 and KIR2DL2 proteins as a result of a three base pair deletion in exon 7. Finally, the cytoplasmic region of KIR proteins exhibits greater length variations, ranging from 23 amino acid residues in some KIR3DS1 alleles to the 96 amino acid residues present in KIR3DL2 proteins.

Amino acid sequences for human KIR polypeptides (*Homo sapiens*) are available in the NCBI database, see e.g., accession number NP_037421.2 (GI: 134268644), NP_703144.2 (GI: 46488946), NP_001229796.1 (GI: 338968852), NP_001229796.1 (GI: 338968852), NP_006728.2 (GI: 134268642), NP_065396.1 (GI: 11968154), NP_001018091.1 (GI: 66267727), NP_001077008.1 (GI: 134133244), NP_036444.1 (GI: 6912472), NP_055327.1 (GI: 7657277), NP_056952.2 (GI: 71143139), NP_036446.3 (GI: 116517309), NP_001074239.1 (GI: 124107610), NP_002246.5 (GI: 124107606), NP_001074241.1 (GI: 124107604), NP_036445.1 (GI: 6912474).

The nomenclature for KIRs is based upon the number of extracellular domains (KIR2D and KIR3D having two and three extracellular Ig-domains, respectively) and whether the cytoplasmic tail is long (KIR2DL or KIR3DL) or short (KIR2DS or KIR3DS). The presence or absence of a given KIR is variable from one NK cell to another within the NK population present in a single individual. Among humans, there is also a relatively high level of polymorphism of KIR genes, with certain KIR genes being present in some, but not all individuals. The expression of KIR alleles on NK cells is stochastically regulated, meaning that, in a given individual, a given lymphocyte may express one, two, or more different KIRs, depending on the genotype of the individual. The NK cells of a single individual typically express different combinations of KIRs, providing a repertoire of NK cells with different specificities for MHC class I molecules.

Certain KIR gene products cause stimulation of lymphocyte activity when bound to an appropriate ligand. The activating KIRs all have a short cytoplasmic tail with a charged trans-membrane residue that associates with an adapter molecule having an Immunoreceptor Tyrosine-based Activation Motifs (ITAMs) which transduce stimulatory signals to the NK cell. By contrast, inhibitory KIRs have a long cytoplasmic tail containing Immunoreceptor Tyrosine-based Inhibitory Motif (ITIM), which transduce inhibitory signals to the NK cell upon engagement of their MHC class I ligands. The known inhibitory KIRs include members of the KIR2DL and KIR3DL subfamilies. Inhibitory KIRs having two Ig domains (KIR2DL) recognize HLA-C allotypes: KIR2DL2 (formerly designated p58.2) and the closely related, allelic gene product KIR2DL3 both recognize "group 1" HLA-C allotypes (including HLA-Cw1, -3, -7, and -8), whereas KIR2DL1 (p58.1) recognizes "group 2" HLA-C allotypes (such as HLA-Cw2, -4, -5, and -6). The recognition by KIR2DL1 is dictated by the presence of a Lys residue at position 80 of HLA-C alleles. KIR2DL2 and KIR2DL3 recognition is dictated by the presence of an Asn residue at position 80 in HLA-C. Importantly, the great majority of HLA-C alleles have either an Asn or a Lys residue at position 80. Therefore, KIR2DL1, -2, and -3 collectively recognize essentially all HLA-C allotypes found in humans. One KIR with three Ig domains, KIR3DL1 (p70), recognizes an epitope shared by HLA-Bw4 alleles. Finally, KIR3DL2 (p140), a homodimer of molecules with three Ig domains, recognizes HLA-A3 and -A11.

However, the invention should not be limited to inhibitory KIRs comprising a cytoplasmic tail containing ITIM. Rather, any inhibitory protein having a cytoplasmic domain that is associated with an inhibitory signal can be used in the construction of the CARs of the invention. Non-limiting examples of an inhibitory protein include but are not limited CTLA-4, PD-1, and the like. These proteins are known to inhibit T cell activation.

Accordingly, the invention provides a KIR-CAR comprising an extracellular domain that comprises a target-specific binding element, otherwise referred to as an antigen binding domain, fused to a KIR or fragment thereof. In one embodiment, the KIR is an activating KIR that comprises a short cytoplasmic tail that associates with an adapter molecule having an Immunoreceptor Tyrosine-based Activation Motifs (ITAMs) which transduce stimulatory signals to the NK cell (referred elsewhere herein as actKIR-CAR). In one embodiment, the KIR is an inhibitory KIR that comprises a long cytoplasmic tail containing Immunoreceptor Tyrosine-based Inhibitory Motif (ITIM), which transduce inhibitory signals (referred elsewhere herein as inhKIR-CAR). In some instances, it is desirable to remove the hinge region for the activating KIRs when construction an actKIR-CAR. This is because the invention is partly based on the discovery that an activating KIR CAR in which the KIR2DS2 hinge was removed to generate the KIR2S CAR, this KIRS2 CAR exhibited enhanced cytolytic activity compared to an actKIR-CAR comprising a full length wildtype KIR2DS2.

The nucleic acid sequences coding for the desired molecules of the invention can be obtained using recombinant methods known in the art, such as, for example by screening libraries from cells expressing the gene, by deriving the gene from a vector known to include the same, or by isolating directly from cells and tissues containing the same, using standard techniques. Alternatively, the gene of interest can be produced synthetically, rather than cloned.

The present invention includes retroviral and lentiviral vector constructs expressing a KIR-CAR that can be directly transduced into a cell. The present invention also includes an RNA construct that can be directly transfected into a cell. A method for generating mRNA for use in transfection involves in vitro transcription (IVT) of a template with specially designed primers, followed by polyA addition, to produce a construct containing 3' and 5' untranslated sequence ("UTR"), a 5' cap and/or Internal Ribosome Entry Site (IRES), the gene to be expressed, and a polyA tail, typically 50-2000 bases in length. RNA so produced can efficiently transfect different kinds of cells. In one embodiment, the template includes sequences for the KIR-CAR.

In an embodiment, a KIR-CAR comprises an antigen binding domain and a KIR transmembrane domain. In an embodiment, a KIR-CAR comprises an antigen binding domain and a KIR intracellular domain, e.g., an inhKIR intracellular domain.

KIR D domain, as that term is used herein, refers to a D0, D1, or D2 domain of a KIR.

KIR D domain, as that term is used herein, refers to a polypeptide domain having structural and functional properties of a D domain of a KIR.

KIR D0 domain, as that term is used herein, refers to a D0 domain of a KIR. In an embodiment the KIR D0 domain of a KIR-CAR has at least 70, 80, 85, 90, 95, or 99% homology with a reference sequence, e.g., a naturally occurring KIR D0 domain or a KIR D0 domain described herein. In embodiments the KIR D0 domain of a KIR-CAR differs at no more than 15, 10, 5, 2, or 1% of its residues from a reference sequence, e.g., a naturally occurring KIR D0 domain or a KIR D0 domain described herein. In embodiments the KIR D0 domain of a KIR-CAR differs at no more than 5, 4, 3, 2 or 1 residue from a reference sequence, e.g., a naturally occurring KIR D0 domain or a KIR D0 domain described herein. In embodiments the KIR D0 domain of a KIR-CAR does not differ from, or shares 100% homology with, a reference sequence, e.g., a naturally occurring KIR D0 domain or a KIR D0 domain described herein.

KIR D1 domain, as that term is used herein, refers to a polypeptide domain having structural and functional properties of a D1 domain of a KIR. In an embodiment the KIR D1 domain of a KIR-CAR has at least 70, 80, 85, 90, 95, or 99% homology with a reference sequence, e.g., a naturally occurring KIR D1 domain or a KIR D1 domain described herein. In embodiments the KIR D1 domain of a KIR-CAR differs at no more than 15, 10, 5, 2, or 1% of its residues from a reference sequence, e.g., a naturally occurring KIR D1 domain or a KIR D1 domain described herein. In embodiments the KIR D1 domain of a KIR-CAR differs at no more than 5, 4, 3, 2 or 1 residue from a reference sequence, e.g., a naturally occurring KIR D0 domain or a KIR D1 domain described herein. In embodiments the KIR D1 domain of a KIR-CAR does not differ from, or shares 100% homology with, a reference sequence, e.g., a naturally occurring KIR D1 domain or a KIR D1 domain described herein.

KIR D2 domain, as that term is used herein, refers to a polypeptide domain having structural and functional properties of a D2 domain of a KIR. In an embodiment the KIR D2 domain of a KIR-CAR has at least 70, 80, 85, 90, 95, or 99% homology with a reference sequence, e.g., a naturally occurring KIR D2 domain or a KIR D2 domain described herein. In embodiments the KIR D2 domain of a KIR-CAR differs at no more than 15, 10, 5, 2, or 1% of its residues from a reference sequence, e.g., a naturally occurring KIR D2 domain or a KIR D2 domain described herein. In embodiments the KIR D2 domain of a KIR-CAR differs at no more than 5, 4, 3, 2 or 1 residue from a reference sequence, e.g., a naturally occurring KIR D2 domain or a KIR D2 domain described herein. In embodiments the KIR D2 domain of a KIR-CAR does not differ from, or shares 100% homology with, a reference sequence, e.g., a naturally occurring KIR D2 domain or a KIR D2 domain described herein.

KIR hinge or stem domain, as that term is used herein, refers to a polypeptide domain having structural and functional properties of a hinge or stem domain of a KIR. In an embodiment the KIR hinge or stem domain of a KIR-CAR has at least 70, 80, 85, 90, 95, or 99% homology with a reference sequence, e.g., a naturally occurring KIR hinge or stem domain or a KIR hinge or stem domain described herein. In embodiments the KIR hinge or stem domain of a KIR-CAR differs at no more than 15, 10, 5, 2, or 1% of its residues from a reference sequence, e.g., a naturally occurring KIR hinge or stem domain or a KIR hinge or stem domain described herein. In embodiments the KIR hinge or stem domain of a KIR-CAR differs at no more than 5, 4, 3, 2 or 1 residue from a reference sequence, e.g., a naturally occurring KIR hinge or stem domain or a KIR hinge or stem domain described herein. In embodiments the KIR hinge or stem domain of a KIR-CAR does not differ from, or shares 100% homology with, a reference sequence, e.g., a naturally occurring KIR hinge or stem domain or a KIR hinge or stem domain described herein.

KIR transmembrane domain, as that term is used herein, refers to a polypeptide domain having structural and functional properties of a transmembrane domain of a KIR. In an embodiment the KIR transmembrane domain of a KIR-CAR has at least 70, 80, 85, 90, 95, or 99% homology with a reference sequence, e.g., a naturally occurring KIR transmembrane domain or a KIR transmembrane domain described herein. In embodiments the KIR transmembrane domain of a KIR-CAR differs at no more than 15, 10, 5, 2, or 1% of its residues from a reference sequence, e.g., a naturally occurring KIR transmembrane domain or a KIR transmembrane domain described herein. In embodiments the KIR transmembrane domain of a KIR-CAR differs at no more than 5, 4, 3, 2 or 1 residue from a reference sequence, e.g., a naturally occurring KIR transmembrane domain or a KIR transmembrane domain described herein. In embodiments the KIR transmembrane domain of a KIR-CAR does not differ from, or shares 100% homology with, a reference sequence, e.g., a naturally occurring KIR transmembrane domain or a KIR transmembrane domain described herein.

KIR intracellular domain, as that term is used herein, refers to a polypeptide domain having structural and functional properties of an intracellular domain of a KIR. KIR intracellular domains comprise inhibitory KIR intracellular domains (referred to herein as inhKIR intracellular domains) and activating KIR intracellular domains (referred to herein as actKIR intracellular domains). In an embodiment the inhKIR intracellular domain comprises an ITIM sequence. In an embodiment the KIR intracellular domain of a KIR-CAR has at least 70, 80, 85, 90, 95, or 99% homology with a reference sequence, e.g., a naturally occurring KIR intracellular domain or a KIR intracellular domain described herein. In embodiments the KIR intracellular domain of a KIR-CAR differs at no more than 15, 10, 5, 2, or 1% of its residues from a reference sequence, e.g., a naturally occurring KIR intracellular domain or a KIR intracellular domain described herein. In embodiments the KIR intracellular domain of a KIR-CAR differs at no more than 5, 4, 3, 2 or 1 residue from a reference sequence, e.g., a naturally occurring KIR intracellular domain or a KIR intracellular domain described herein. In embodiments the KIR intracellular domain of a KIR-CAR does not differ from, or shares 100% homology with, a reference sequence, e.g., a naturally occurring KIR intracellular domain or a KIR intracellular domain described herein.

NCRs

NKR-CARs described herein include NCR-CARs, which share functional and structural properties with NCRs.

Natural killer (NK) cells are cytotoxic lymphoid cells specialized in destroying tumors and virus-infected cells. Unlike cytotoxic T lymphocytes, NK cells do not express antigen-specific receptors. The recognition of transformed cells occurs via the association of a multitude of cell-surface receptors with surface markers on the target cell. The NK cell surface receptors can be distinguished according to whether they activate or inhibit NK cell-mediated cytotoxicity. Numerous interactions between different receptors appear to lead to the formation of synapses between NK and target cells. The integration of activating and inhibiting signals at the synapse dictates whether or not the NK cells exert their cytolytic function on the target cell. Among the activating receptors, the family of Ig-like molecules is termed natural cytotoxicity receptors (NCRs). These natural cytotoxicity receptors include NKp30, NKp44 and NKp46 molecules. The NCRs are key activating receptors for NK cells in tumor cell recognition. All three NCRs are involved in the clearance of both tumor and virus-infected cells. In the latter, the antiviral activity is initiated by the interaction of NKp44 with hemagglutinin of influenza virus or Sendai virus. NKp46 targets virus-infected cells by binding to influenza virus hemagglutinin or Sendai virus hemagglutinin-neuraminidase. In contrast, it has been shown that NK cell-mediated cytotoxicity is inhibited by binding of NKp30 to the human cytomegaloviral protein pp65 (see, e.g., Arnon, et. al., Nat. Immunol. (2005) 6:515-523).

Amino acid sequences for a human NCR polypeptides (*Homo sapiens*) are available in the NCBI database, see e.g., accession number NP_004819.2 (GI: 153945782), O14931.1 (GI: 47605770), O95944.2 (GI: 251757303), O76036.1 (GI: 47605775), NP_001138939.1 (GI: 224586865), and/or NP_001138938.1 (GI: 224586860).

In an embodiment, a NCR-CAR comprises an antigen binding domain and a NCR transmembrane domain. In an embodiment, a KIR-CAR comprises an antigen binding domain and a NCR intracellular domain.

NCR extracellular domain, as that term is used herein, refers to a polypeptide domain having structural and functional properties of an extracellular domain of a NCR. In an embodiment the NCR extracellular domain of a NCR-CAR has at least 70, 80, 85, 90, 95, or 99% homology with a reference sequence, e.g., a naturally occurring NCR extracellular domain or a NCR extracellular domain described herein. In embodiments the NCR extracellular domain of a NCR-CAR differs at no more than 15, 10, 5, 2, or 1% of its residues from a reference sequence, e.g., a naturally occurring NCR extracellular domain or a NCR extracellular domain described herein. In embodiments the NCR extracellular domain of a NCR-CAR differs at no more than 5, 4, 3, 2 or 1 residue from a reference sequence, e.g., a naturally occurring NCR extracellular domain or a NCR extracellular domain described herein. In embodiments the NCR extracellular domain of a NCR-CAR does not differ from, or shares 100% homology with, a reference sequence, e.g., a naturally occurring NCR extracellular domain or a NCR extracellular domain described herein.

NCR hinge or stem domain, as that term is used herein, refers to a polypeptide domain having structural and functional properties of a hinge or stem domain of a NCR. In an embodiment the NCR hinge or stem domain of a NCR-CAR has at least 70, 80, 85, 90, 95, or 99% homology with a reference sequence, e.g., a naturally occurring NCR hinge or stem domain or a NCR hinge or stem domain described herein. In embodiments the NCR hinge or stem domain of a NCR-CAR differs at no more than 15, 10, 5, 2, or 1% of its residues from a reference sequence, e.g., a naturally occurring NCR hinge or stem domain or a NCR hinge or stem domain described herein. In embodiments the NCR hinge or stem domain of a NCR-CAR differs at no more than 5, 4, 3, 2 or 1 residue from a reference sequence, e.g., a naturally occurring NCR hinge or stem domain or a NCR hinge or stem domain described herein. In embodiments the NCR hinge or stem domain of a NCR-CAR does not differ from, or shares 100% homology with, a reference sequence, e.g., a naturally occurring NCR hinge or stem domain or a NCR hinge or stem domain described herein.

NCR transmembrane domain, as that term is used herein, refers to a polypeptide domain having structural and functional properties of a transmembrane domain of a NCR. In an embodiment the NCR transmembrane domain of a NCR-CAR has at least 70, 80, 85, 90, 95, or 99% homology with a reference sequence, e.g., a naturally occurring NCR transmembrane domain or a NCR transmembrane domain described herein. In embodiments the NCR transmembrane domain of a NCR-CAR differs at no more than 15, 10, 5, 2, or 1% of its residues from a reference sequence, e.g., a naturally occurring NCR transmembrane domain or a NCR transmembrane domain described herein. In embodiments the NCR transmembrane domain of a NCR-CAR differs at no more than 5, 4, 3, 2 or 1 residue from a reference sequence, e.g., a naturally occurring NCR transmembrane domain or a NCR transmembrane domain described herein. In embodiments the NCR transmembrane domain of a NCR-CAR does not differ from, or shares 100% homology with, a reference sequence, e.g., a naturally occurring NCR transmembrane domain or a NCR transmembrane domain described herein.

NCR intracellular domain, as that term is used herein, refers to a polypeptide domain having structural and functional properties of an intracellular domain of a NCR. In an embodiment the NCR intracellular domain of a NCR-CAR has at least 70, 80, 85, 90, 95, or 99% homology with a reference sequence, e.g., a naturally occurring NCR intracellular domain or a NCR intracellular domain described herein. In embodiments the NCR intracellular domain of a NCR-CAR differs at no more than 15, 10, 5, 2, or 1% of its residues from a reference sequence, e.g., a naturally occurring NCR intracellular domain or a NCR intracellular domain described herein. In embodiments the NCR intracellular domain of a NCR-CAR differs at no more than 5, 4, 3, 2 or 1 residue from a reference sequence, e.g., a naturally occurring NCR intracellular domain or a NCR intracellular domain described herein. In embodiments the NCR intracellular domain of a NCR-CAR does not differ from, or shares 100% homology with, a reference sequence, e.g., a naturally occurring NCR intracellular domain or a NCR intracellular domain described herein.

SLAM Receptors

NKR-CARs described herein include SLAMF-CARs, which share functional and structural properties with SLAMFs.

The signaling lymphocyte activation molecule (SLAM) family of immune cell receptors is closely related to the CD2 family of the immunoglobulin (Ig) superfamily of molecules. The SLAM family (SLAMF) currently includes nine members named SLAM, CD48, CD229, 2B4, CD84, NTB-A, CRACC, BLAME, and CD2F-10. In general, SLAM molecules possess two to four extracellular Ig domains, a transmembrane segment, and an intracellular tyrosine-rich region. The molecules are differentially expressed on a variety of immune cell types. Several are self ligands and SLAM has been identified as the human measles virus receptor. Several small SH2-containing adaptor proteins are known to associate with the intracellular domains of SLAM family members and modulate receptor signaling including SH2D1A (also known as SLAM-associated protein [SAP]) and SH2D1B (also known as EAT2). For example, in T and NK cells, activated SLAM family receptors become tyrosine phosphorylated and recruit the adaptor SAP and subsequently the Src kinase Fyn. The ensuing signal transduction cascade influences the outcome of T cell-antigen presenting cell and NK cell-target cell interactions.

Amino acid sequences for human SLAM receptor polypeptides (*Homo sapiens*) are available in the NCBI database, see e.g., accession number NP_057466.1 (GI: 7706529), NP_067004.3 (GI: 19923572), NP_003028.1 (GI: 4506969), NP_001171808.1 (GI: 296434285), NP_001171643.1 (GI: 296040491), NP_001769.2 (GI: 21361571), NP_254273.2 (GI: 226342990), NP_064510.1 (GI: 9910342) and/or NP_002339.2 (GI: 55925578)

In an embodiment, a SLAMF-CAR comprises an antigen binding domain and a SLAMF transmembrane domain. In an embodiment, a SLAMF-CAR comprises an antigen binding domain and a SLAMF intracellular domain.

SLAMF extracellular domain, as that term is used herein, refers to a polypeptide domain having structural and functional properties of an extracellular domain of a SLAMF. In an embodiment the SLAMF extracellular domain of a SLAMF-CAR has at least 70, 80, 85, 90, 95, or 99% homology with a reference sequence, e.g., a naturally occurring SLAMF extracellular domain or a SLAMF extracellular domain described herein. In embodiments the SLAMF extracellular domain of a SLAMF-CAR differs at no more than 15, 10, 5, 2, or 1% of its residues from a reference sequence, e.g., a naturally occurring SLAMF extracellular domain or a SLAMF extracellular domain described herein. In embodiments the SLAMF extracellular domain of a SLAMF-CAR differs at no more than 5, 4, 3, 2 or 1 residue from a reference sequence, e.g., a naturally occurring SLAMF extracellular domain or a SLAMF extracellular domain described herein. In embodiments the SLAMF extracellular domain of a SLAMF-CAR does not differ from, or shares 100% homology with, a reference sequence, e.g., a naturally occurring SLAMF extracellular domain or a SLAMF extracellular domain described herein.

SLAMF hinge or stem domain, as that term is used herein, refers to a polypeptide domain having structural and functional properties of a hinge or stem domain of a SLAMF. In an embodiment the SLAMF hinge or stem domain of a SLAMF-CAR has at least 70, 80, 85, 90, 95, or 99% homology with a reference sequence, e.g., a naturally occurring SLAMF hinge or stem domain or a SLAMF hinge or stem domain described herein. In embodiments the SLAMF hinge or stem domain of a SLAMF-CAR differs at no more than 15, 10, 5, 2, or 1% of its residues from a reference sequence, e.g., a naturally occurring SLAMF hinge or stem domain or a SLAMF hinge or stem domain described herein. In embodiments the SLAMF hinge or stem domain of a SLAMF-CAR differs at no more than 5, 4, 3, 2 or 1 residue from a reference sequence, e.g., a naturally occurring SLAMF hinge or stem domain or a SLAMF hinge or stem domain described herein. In embodiments the SLAMF hinge or stem domain of a SLAMF-CAR does not differ from, or shares 100% homology with, a reference sequence, e.g., a naturally occurring SLAMF hinge or stem domain or a SLAMF hinge or stem domain described herein.

SLAMF transmembrane domain, as that term is used herein, refers to a polypeptide domain having structural and functional properties of a transmembrane domain of a SLAMF. In an embodiment the SLAMF transmembrane domain of a SLAMF-CAR has at least 70, 80, 85, 90, 95, or 99% homology with a reference sequence, e.g., a naturally occurring SLAMF transmembrane domain or a SLAMF transmembrane domain described herein. In embodiments the SLAMF transmembrane domain of a SLAMF-CAR differs at no more than 15, 10, 5, 2, or 1% of its residues from a reference sequence, e.g., a naturally occurring SLAMF transmembrane domain or a SLAMF transmembrane domain described herein. In embodiments the SLAMF transmembrane domain of a SLAMF-CAR differs at no more than 5, 4, 3, 2 or 1 residue from a reference sequence, e.g., a naturally occurring SLAMF transmembrane domain or a SLAMF transmembrane domain described herein. In embodiments the SLAMF transmembrane domain of a SLAMF-CAR does not differ from, or shares 100% homology with, a reference sequence, e.g., a naturally occurring SLAMF transmembrane domain or a SLAMF transmembrane domain described herein.

SLAMF intracellular domain, as that term is used herein, refers to a polypeptide domain having structural and functional properties of an intracellular domain of a SLAMF. In an embodiment the SLAMF intracellular domain of a SLAMF-CAR has at least 70, 80, 85, 90, 95, or 99% homology with a reference sequence, e.g., a naturally occurring SLAMF intracellular domain or a SLAMF intracellular domain described herein. In embodiments the SLAMF intracellular domain of a SLAMF-CAR differs at no more than 15, 10, 5, 2, or 1% of its residues from a reference sequence, e.g., a naturally occurring SLAMF intracellular domain or a SLAMF intracellular domain described herein. In embodiments the SLAMF intracellular domain of a SLAMF-CAR differs at no more than 5, 4, 3, 2 or 1 residue from a reference sequence, e.g., a naturally occurring SLAMF intracellular domain or a SLAMF intracellular domain described herein. In embodiments the SLAMF intracellular domain of a SLAMF-CAR does not differ from, or shares 100% homology with, a reference sequence, e.g., a naturally occurring SLAMF intracellular domain or a SLAMF intracellular domain described herein.

Fc-Binding Receptors

NKR-CARs described herein include CARs based on the Fc receptors, FcR-CARs, e.g., CD16-CARs, and CD64-CARs, which share functional and structural properties with CD16 and CD64.

Upon activation, NK cells produce cytokines and chemokines abundantly and at the same time exhibit potent cytolytic activity. Activation of NK cells can occur through the direct binding of NK cell receptors to ligands on the target cell, as seen with direct tumor cell killing, or through the crosslinking of the Fc receptor (CD 16; FcγRIII) by binding to the Fc portion of antibodies bound to an antigen-bearing cell. This CD16 engagement (CD16 crosslinking) initiates NK cell responses via intracellular signals that are generated through one, or both, of the CD16-associated adaptor chains, FcRγ or CD3ζ. Triggering of CD16 leads to phosphorylation of the γ or ζ chain, which in turn recruits tyrosine kinases, syk and ZAP-70, initiating a cascade of signal transduction leading to rapid and potent effector functions. The most well-known effector function is the release of cytoplasmic granules carrying toxic proteins to kill nearby target cells through the process of antibody-dependent cellular cytotoxicity. CD16 crosslinking also results in the production of cytokines and chemokines that, in turn, activate and orchestrate a series of immune responses.

However, unlike T and B lymphocytes, NK cells are thought to have only a limited capacity for target recognition using germline-encoded activation receptors (Bottino et al., Curr Top Microbiol Immunol. 298:175-182 (2006); Stewart et al., Curr Top Microbiol Immunol. 298:1-21 (2006)). NK cells express the activating Fc receptor CD 16, which recognizes IgG-coated target cells, thereby broadening target recognition (Ravetch & Bolland, Annu Rev Immunol. 19:275-290 (2001); Lanier Nat. Immunol. 9(5):495-502 (2008); Bryceson & Long, Curr Opin Immunol. 20(3):344-352 (2008)). The expression and signal transduction activity of several NK cell activation receptors requires physically associated adaptors, which transduce signals through immunoreceptor tyrosine-based activation motifs (ITAMs). Among these adaptors, FcRγ and CD3ζ chains can associate with CD16 and natural cytotoxicity receptors (NCRs) as either disulfide-linked homo-dimers or hetero-dimers, and these chains have been thought to be expressed by all mature NK cells.

Amino acid sequence for CD16 (*Homo sapiens*) is available in the NCBI database, see e.g., accession number NP_000560.5 (GI: 50726979), NP_001231682.1 (GI: 348041254)

In an embodiment, a FcR-CAR comprises an antigen binding domain and a FcR transmembrane domain. In an embodiment, a FcR-CAR comprises an antigen binding domain and a FcR intracellular domain.

CD16 extracellular domain, as that term is used herein, refers to a polypeptide domain having structural and functional properties of a extracellular domain of a CD16. In an embodiment the CD16 extracellular domain of a CD16-CAR has at least 70, 80, 85, 90, 95, or 99% homology with a reference sequence, e.g., a naturally occurring CD16 extracellular domain or a CD16 extracellular domain described herein. In embodiments the CD16 extracellular domain of a CD16-CAR differs at no more than 15, 10, 5, 2, or 1% of its residues from a reference sequence, e.g., a naturally occurring CD16 extracellular domain or a CD16 extracellular domain described herein. In embodiments the CD16 extracellular domain of a CD16-CAR differs at no more than 5, 4, 3, 2 or 1 residue from a reference sequence, e.g., a naturally occurring CD16 extracellular domain or a CD16 extracellular domain described herein. In embodiments the CD16 extracellular domain of a CD16-CAR does not differ from, or shares 100% homology with, a reference sequence, e.g., a naturally occurring CD16 extracellular domain or a CD16 extracellular domain described herein.

CD16 hinge or stem domain, as that term is used herein, refers to a polypeptide domain having structural and functional properties of a hinge or stem domain of a CD16. In an embodiment the CD16 hinge or stem domain of a CD16-CAR has at least 70, 80, 85, 90, 95, or 99% homology with a reference sequence, e.g., a naturally occurring CD16 hinge or stem domain or a CD16 hinge or stem domain described herein. In embodiments the CD16 hinge or stem domain of a CD16-CAR differs at no more than 15, 10, 5, 2, or 1% of its residues from a reference sequence, e.g., a naturally occurring CD16 hinge or stem domain or a CD16 hinge or stem domain described herein. In embodiments the CD16 hinge or stem domain of a CD16-CAR differs at no more than 5, 4, 3, 2 or 1 residue from a reference sequence, e.g., a naturally occurring CD16 hinge or stem domain or a CD16 hinge or stem domain described herein. In embodiments the CD16 hinge or stem domain of a CD16-CAR does not differ from, or shares 100% homology with, a reference sequence, e.g., a naturally occurring CD16 hinge or stem domain or a CD16 hinge or stem domain described herein.

CD16 transmembrane domain, as that term is used herein, refers to a polypeptide domain having structural and functional properties of a transmembrane domain of a CD16. In an embodiment the CD16 transmembrane domain of a CD16-CAR has at least 70, 80, 85, 90, 95, or 99% homology with a reference sequence, e.g., a naturally occurring CD16 transmembrane domain or a CD16 transmembrane domain described herein. In embodiments the CD16 transmembrane domain of a CD16-CAR differs at no more than 15, 10, 5, 2, or 1% of its residues from a reference sequence, e.g., a naturally occurring CD16 transmembrane domain or a CD16 transmembrane domain described herein. In embodiments the CD16 transmembrane domain of a CD16-CAR differs at no more than 5, 4, 3, 2 or 1 residue from a reference sequence, e.g., a naturally occurring CD16 transmembrane domain or a CD16 transmembrane domain described herein. In embodiments the CD16 transmembrane domain of a CD16-CAR does not differ from, or shares 100% homology with, a reference sequence, e.g., a naturally occurring CD16 transmembrane domain or a CD16 transmembrane domain described herein.

CD16 intracellular domain, as that term is used herein, refers to a polypeptide domain having structural and functional properties of an intracellular domain of a CD16. In an embodiment the CD16 intracellular domain of a CD16-CAR has at least 70, 80, 85, 90, 95, or 99% homology with a reference sequence, e.g., a naturally occurring CD16 intracellular domain or a CD16 intracellular domain described herein. In embodiments the CD16 intracellular domain of a CD16-CAR differs at no more than 15, 10, 5, 2, or 1% of its residues from a reference sequence, e.g., a naturally occurring CD16 intracellular domain or a CD16 intracellular domain described herein. In embodiments the CD16 intracellular domain of a CD16-CAR differs at no more than 5, 4, 3, 2 or 1 residue from a reference sequence, e.g., a naturally occurring CD16 intracellular domain or a CD16 intracellular domain described herein. In embodiments the CD16 intracellular domain of a CD16-CAR does not differ from, or shares 100% homology with, a reference sequence, e.g., a naturally occurring CD16 intracellular domain or a CD16 intracellular domain described herein.

CD64 extracellular domain, as that term is used herein, refers to a polypeptide domain having structural and functional properties of a extracellular domain of a CD64. In an embodiment the CD64 extracellular domain of a CD64-CAR has at least 70, 80, 85, 90, 95, or 99% homology with a reference sequence, e.g., a naturally occurring CD64 extracellular domain or a CD64 extracellular domain described herein. In embodiments the CD64 extracellular domain of a CD64-CAR differs at no more than 15, 10, 5, 2, or 1% of its residues from a reference sequence, e.g., a naturally occurring CD64 extracellular domain or a CD64 extracellular domain described herein. In embodiments the CD64 extracellular domain of a CD64-CAR differs at no more than 5, 4, 3, 2 or 1 residue from a reference sequence, e.g., a naturally occurring CD64 extracellular domain or a CD64 extracellular domain described herein. In embodiments the CD64 extracellular domain of a CD64-CAR does not differ from, or shares 100% homology with, a reference sequence, e.g., a naturally occurring CD64 extracellular domain or a CD64 extracellular domain described herein.

CD64 hinge or stem domain, as that term is used herein, refers to a polypeptide domain having structural and functional properties of a hinge or stem domain of a CD64. In an embodiment the CD64 hinge or stem domain of a CD64-CAR has at least 70, 80, 85, 90, 95, or 99% homology with a reference sequence, e.g., a naturally occurring CD64 hinge or stem domain or a CD64 hinge or stem domain described herein. In embodiments the CD64 hinge or stem domain of a CD64-CAR differs at no more than 15, 10, 5, 2, or 1% of its residues from a reference sequence, e.g., a naturally occurring CD64 hinge or stem domain or a CD64 hinge or stem domain described herein. In embodiments the CD64 hinge or stem domain of a CD64-CAR differs at no more than 5, 4, 3, 2 or 1 residue from a reference sequence, e.g., a naturally occurring CD64 hinge or stem domain or a CD64 hinge or stem domain described herein. In embodiments the CD64 hinge or stem domain of a CD64-CAR does not differ from, or shares 100% homology with, a reference sequence, e.g., a naturally occurring CD64 hinge or stem domain or a CD64 hinge or stem domain described herein.

CD64 transmembrane domain, as that term is used herein, refers to a polypeptide domain having structural and functional properties of a transmembrane domain of a CD64. In an embodiment the CD64 transmembrane domain of a CD64-CAR has at least 70, 80, 85, 90, 95, or 99% homology with a reference sequence, e.g., a naturally occurring CD64 transmembrane domain or a CD64 transmembrane domain described herein. In embodiments the CD64 transmembrane domain of a CD64-CAR differs at no more than 15, 10, 5, 2, or 1% of its residues from a reference sequence, e.g., a naturally occurring CD64 transmembrane domain or a CD64 transmembrane domain described herein. In embodiments the CD64 transmembrane domain of a CD64-CAR differs at no more than 5, 4, 3, 2 or 1 residue from a reference sequence, e.g., a naturally occurring CD64 transmembrane domain or a CD64 transmembrane domain described herein. In embodiments the CD64 transmembrane domain of a CD64-CAR does not differ from, or shares 100% homology with, a reference sequence, e.g., a naturally occurring CD64 transmembrane domain or a CD64 transmembrane domain described herein.

CD64 intracellular domain, as that term is used herein, refers to a polypeptide domain having structural and functional properties of an intracellular domain of a CD64. In an embodiment the CD64 intracellular domain of a CD64-CAR has at least 70, 80, 85, 90, 95, or 99% homology with a reference sequence, e.g., a naturally occurring CD64 intracellular domain or a CD64 intracellular domain described herein. In embodiments the CD64 intracellular domain of a CD64-CAR differs at no more than 15, 10, 5, 2, or 1% of its residues from a reference sequence, e.g., a naturally occurring CD64 intracellular domain or a CD64 intracellular domain described herein. In embodiments the CD64 intracellular domain of a CD64-CAR differs at no more than 5, 4, 3, 2 or 1 residue from a reference sequence, e.g., a naturally occurring CD64 intracellular domain or a CD64 intracellular domain described herein. In embodiments the CD64 intracellular domain of a CD64-CAR does not differ from, or shares 100% homology with, a reference sequence, e.g., a naturally occurring CD64 intracellular domain or a CD64 intracellular domain described herein.

Ly49 and Related Killer Cell Lectin-Like Receptors

NKR-CARs described herein include Ly49-CARs, which share functional and structural properties with Ly49.

The Ly49 receptors derive from at least 23 identified genes (Ly49A-W) in mice. These receptors share many of the same roles in mouse NK cells and T cells as that played by KIRs in humans despite their different structure (type II integral membrane proteins of the C-type lectin superfamily), and they also contain a considerable degree of genetic variation like human KIRs. The remarkable functional similarity between Ly49 and KIR receptors suggest that these groups of receptors have evolved independently yet convergently to perform the same physiologic functionals in NK cells and T cells.

Like KIRs in humans, different Ly49 receptors recognize different MHC class I alleles and are differentially expressed on subsets of NK cells. The original prototypic Ly49 receptors, Ly49A and Ly49C possess a cytoplasmic domain bearing two immunotyrosine-based inhibitory motifs (ITIM) similar to inhibitory KIRs such as KIR2DL3. These domains have been identified to recruit the phosphatase, SHP-1, and like the inhibitory KIRs, serve to limit the activation of NK cells and T cells. In addition to the inhibitory Ly49 molecules, several family members such as Ly49D and Ly49H have lost the ITIM-containing domains, and have instead acquired the capacity to interact with the signaling adaptor molecule, DAP12 similar to the activating KIRs such as KIR2DS2 in humans.

Amino acid sequence for Ly49 family members are available in the NCBI database, see e.g., accession numbers AAF82184.1 (GI: 9230810), AAF99547.1 (GI: 9801837), NP_034778.2 (GI: 133922593), NP_034779.1 (GI: 6754462), NP_001095090.1 (GI: 197333718), NP_034776.1 (GI: 21327665), AAK11559.1 (GI: 13021834) and/or NP_038822.3 (GI: 9256549).

In an embodiment, a Ly49-CAR comprises an antigen binding domain and a Ly49 transmembrane domain. In an embodiment, a Ly49-CAR comprises an antigen binding domain and a Ly49 intracellular domain.

LY49 extracellular domain, as that term is used herein, refers to a polypeptide domain having structural and functional properties of n extracellular domain of a LY49. In an embodiment the LY49 extracellular domain of a LY49-CAR has at least 70, 80, 85, 90, 95, or 99% homology with a reference sequence, e.g., a naturally occurring LY49 extracellular domain or a LY49 extracellular domain described herein. In embodiments the LY49 extracellular domain of a LY49-CAR differs at no more than 15, 10, 5, 2, or 1% of its residues from a reference sequence, e.g., a naturally occurring LY49 extracellular domain or a LY49 extracellular domain described herein. In embodiments the LY49 extracellular domain of a LY49-CAR differs at no more than 5, 4, 3, 2 or 1 residue from a reference sequence, e.g., a naturally occurring LY49 extracellular domain or a LY49 extracellular domain described herein. In embodiments the LY49 extracellular domain of a LY49-CAR does not differ from, or shares 100% homology with, a reference sequence, e.g., a naturally occurring LY49 extracellular domain or a LY49 extracellular domain described herein.

LY49 hinge or stem domain, as that term is used herein, refers to a polypeptide domain having structural and functional properties of a hinge or stem domain of a LY49. In an embodiment the LY49 hinge or stem domain of a LY49-CAR has at least 70, 80, 85, 90, 95, or 99% homology with a reference sequence, e.g., a naturally occurring LY49 hinge or stem domain or a LY49 hinge or stem domain described herein. In embodiments the LY49 hinge or stem domain of a LY49-CAR differs at no more than 15, 10, 5, 2, or 1% of its residues from a reference sequence, e.g., a naturally occurring LY49 hinge or stem domain or a LY49 hinge or stem domain described herein. In embodiments the LY49 hinge or stem domain of a LY49-CAR differs at no more than 5, 4, 3, 2 or 1 residue from a reference sequence, e.g., a naturally occurring LY49 hinge or stem domain or a LY49 hinge or stem domain described herein. In embodiments the LY49 hinge or stem domain of a LY49-CAR does not differ from, or shares 100% homology with, a reference sequence, e.g., a naturally occurring LY49 hinge or stem domain or a LY49 hinge or stem domain described herein.

LY49 transmembrane domain, as that term is used herein, refers to a polypeptide domain having structural and functional properties of a transmembrane domain of a LY49. In an embodiment the LY49 transmembrane domain of a LY49-CAR has at least 70, 80, 85, 90, 95, or 99% homology with a reference sequence, e.g., a naturally occurring LY49 transmembrane domain or a LY49 transmembrane domain described herein. In embodiments the LY49 transmembrane domain of a LY49-CAR differs at no more than 15, 10, 5, 2, or 1% of its residues from a reference sequence, e.g., a naturally occurring LY49 transmembrane domain or a LY49 transmembrane domain described herein. In embodiments the LY49 transmembrane domain of a LY49-CAR differs at no more than 5, 4, 3, 2 or 1 residue from a reference sequence, e.g., a naturally occurring LY49 transmembrane domain or a LY49 transmembrane domain described herein. In embodiments the LY49 transmembrane domain of a LY49-CAR does not differ from, or shares 100% homology with, a reference sequence, e.g., a naturally occurring LY49 transmembrane domain or a LY49 transmembrane domain described herein.

LY49 intracellular domain, as that term is used herein, refers to a polypeptide domain having structural and functional properties of an intracellular domain of a LY49. In an embodiment the LY49 intracellular domain of a LY49-CAR has at least 70, 80, 85, 90, 95, or 99% homology with a reference sequence, e.g., a naturally occurring LY49 intracellular domain or a LY49 intracellular domain described herein. In embodiments the LY49 intracellular domain of a LY49-CAR differs at no more than 15, 10, 5, 2, or 1% of its residues from a reference sequence, e.g., a naturally occurring LY49 intracellular domain or a LY49 intracellular domain described herein. In embodiments the LY49 intracellular domain of a LY49-CAR differs at no more than 5, 4, 3, 2 or 1 residue from a reference sequence, e.g., a naturally occurring LY49 intracellular domain or a LY49 intracellular domain described herein. In embodiments the LY49 intracellular domain of a LY49-CAR does not differ from, or shares 100% homology with, a reference sequence, e.g., a naturally occurring LY49 intracellular domain or a LY49 intracellular domain described herein.

Intracellular Signaling Domains or Adaptor Molecules, e.g., DAP12

Some NKR-CARs interact with other molecules, e.g., molecules comprising an intracellular signaling domain, e.g., an ITAM. In an embodiment an intracellular signaling domain is DAP12.

DAP12 is so named because of its structural features, and presumed function. Certain cell surface receptors lack intrinsic functionality, which hypothetically may interact with another protein partner, suggested to be a 12 kD protein. The mechanism of the signaling may involve an ITAM signal.

The DAP12 was identified from sequence databases based upon a hypothesized relationship to CD3 (see Olcese, et al. (1997) J. Immunol. 158:5083-5086), the presence of an ITAM sequence (see Thomas (1995) J. Exp. Med. 181:1953-1956), certain size predictions (see Olcese; and Takase, et al. (1997) J. Immunol. 159:741-747, and other features. In particular, the transmembrane domain was hypothesized to contain a charged residue, which would allow a salt bridge with the corresponding transmembrane segments of its presumed receptor partners, KIR CD94 protein, and possibly other similar proteins. See Daeron, et al. (1995) Immunity 3:635-646.

In fact, many of the known KIR, MIR, ILT, and CD94/NKG2 receptor molecules may actually function with an accessory protein which is part of the functional receptor complex. See Olcese, et al. (1997) J. Immunol. 158:5083-5086; and Takase, et al. (1997) J. Immunol. 159:741-747.

A DAP 12 domain, as that term is used herein, refers to a polypeptide domain having structural and functional properties of a cytoplasmic domain of a DAP 12, and will typically include an ITAM domain. In an embodiment a DAP 12 domain of a KIR-CAR has at least 70, 80, 85, 90, 95, or 99% homology with a reference sequence, e.g., a naturally occurring DAP 12 or a DAP 12 described herein. In embodiments the DAP 12 domain of a KIR-CAR differs at no more than 15, 10, 5, 2, or 1% of its residues from a reference sequence, e.g., a naturally occurring DAP12 or a DAP12 described herein. In embodiments the DAP 12 domain of a KIR-CAR differs at no more than 5, 4, 3, 2 or 1 residue from a reference sequence, e.g., a naturally occurring DAP12 or a DAP12 described herein. In embodiments the DAP 12 domain of a KIR-CAR does not differ from, or shares 100% homology with, a reference sequence, e.g., a naturally occurring DAP12 or a DAP12 described herein.

The DAP10 was identified partly by its homology to the DAP12, and other features. In particular, in contrast to the DAP12, which exhibits an ITAM activation motif, the DAP10 exhibits an ITIM inhibitory motif. The MDL-1 was identified by its functional association with DAP12.

The functional interaction between, e.g., DAP12 or DAP10, and its accessory receptor may allow use of the structural combination in receptors which normally are not found in a truncated receptor form. Thus, the mechanism of signaling through such accessory proteins as the DAP12 and DAP10 allow for interesting engineering of other KIR-like receptor complexes, e.g., with the KIR, MIR, ILT, and CD94 NKG2 type receptors. Truncated forms of intact receptors may be constructed which interact with a DAP12 or DAP10 to form a functional signaling complex.

The primate nucleotide sequence of DAP12 corresponds to nucleotides 1 to 339 of SEQ ID NO: 332; the amino acid sequence corresponds to amino acids 1 to 113 of SEQ ID NO: 333. The signal sequence appears to run from met(-26) to gln(-1) or ala1; the mature protein should run from about ala1 (or gln2), the extracellular domain from about ala1 to pro14; the extracellular domain contains two cysteines at 7 and 9, which likely allow disulfide linkages to additional homotypic or heterotypic accessory proteins; the transmembrane region runs from about gly15 or val16 to about gly39; and an ITAM motif from tyr65 to leu79 (YxxL-6/8x-YxxL) (SEQ ID NO: 341). The LVA03A EST was identified and used to extract other overlapping sequences. See also Genbank Human ESTs that are part of human DAP12; some, but not all, inclusive Genbank Accession # AA481924; H39980; W60940; N41026; R49793; W60864; W92376; H12338; T52100; AA480109; H12392; W74783; and T55959.

Inhibitory NKR-CARs

The present invention provides compositions and methods for limiting the depletion of non-cancerous cells by a type of CAR T cell therapy. As disclosed herein, a type of CAR T cell therapy comprises the use of NK receptors including but is not limited to activating and inhibitory receptors of NK cells known as killer cell immunoglobulin-like receptor (KIR). Accordingly the invention provides compositions and methods of using a NKR-CAR, e.g., a KIR-CAR, including but is not limited to an activating NKR-CAR (actNKR-CAR), e.g., an activating KIR-CAR (actKIR-CAR) and an inhibitory NKR-CAR (inhNKR-CAR), e.g., an inhibitory KIR-CAR (inhKIR-CAR).

In some embodiments, the KIR of an inhKIR-CARs is an inhibitory KIR that comprises a long cytoplasmic tail containing Immunoreceptor Tyrosine-based Inhibitory Motif (ITIM), which transduce inhibitory signals (referred elsewhere herein as inhKIR-CAR).

In some embodiments, an inhKIR-CAR comprises a cytoplasmic domain of an inhibitory molecule other than KIR. These inhibitory molecules can, in some embodiments, decrease the ability of a cell to mount an immune effector response. Cytoplasmic domains of inhibitory molecules may be coupled, e.g., by fusion, to transmembrane domains of KIR. Exemplary inhibitory molecules are shown in Table 1:

TABLE 1

Inhibitory molecules

| | | |
|---|---|---|
| PD1 | TIGIT | KIR |
| PD-L1 | LAIR1 | A2aR |
| PD-L2 | CD160 | MHC class I |
| CTLA4 | 2B4 | MHC class II |
| TIM3 | CD80 | GAL9 |
| CEACAM (e.g., CEACAM-1, CEACAM-3, and/or CEACAM-5) | CD86 | Adenosine |
| LAG3 | B7-H3 (CD276) | TGFR (e.g., TGFRbeta) |
| VISTA | B7-H4 (VTCN1) | |
| BTLA | HVEM (TNFRSF14 or CD270) | |

In some embodiments, an inhKIR-CAR comprises a PD1 cytoplasmic domain. A PD1 cytoplasmic domain, as that term is used herein, refers to a polypeptide domain having structural and functional properties of a cytoplasmic domain of a PD1. In an embodiment the PD1 cytoplasmic domain of a KIR-CAR has at least 70, 80, 85, 90, 95, or 99% homology with a reference sequence, e.g., a naturally occurring PD1 cytoplasmic domain or a PD1 cytoplasmic domain described herein (SEQ ID NO: 338). In embodiments the PD1 cytoplasmic domain of a KIR-CAR differs at no more than 15, 10, 5, 2, or 1% of its residues from a reference sequence, e.g., a naturally occurring PD1 cytoplasmic domain or a PD1 cytoplasmic domain described herein. In embodiments the PD1 cytoplasmic domain of a KIR-CAR differs at no more than 5, 4, 3, 2 or 1 residue from a reference sequence, e.g., a naturally occurring PD1 cytoplasmic domain or a PD1 cytoplasmic domain described herein. In embodiments the PD1 cytoplasmic domain of a KIR-CAR does not differ from, or shares 100% homology with, a reference sequence, e.g., a naturally occurring PD1 cytoplasmic domain or a PD1 cytoplasmic domain described herein.

In some embodiments, an inhKIR-CAR comprises a CTLA-4 cytoplasmic domain. A CTLA-4 cytoplasmic domain, as that term is used herein, refers to a polypeptide domain having structural and functional properties of a cytoplasmic domain of a CTLA-4. In an embodiment the CTLA-4 cytoplasmic domain of a KIR-CAR has at least 70, 80, 85, 90, 95, or 99% homology with a reference sequence, e.g., a naturally occurring CTLA-4 cytoplasmic domain or a CTLA-4 cytoplasmic domain described herein (SEQ ID NO: 339). In embodiments the CTLA-4 cytoplasmic domain of a KIR-CAR differs at no more than 15, 10, 5, 2, or 1% of its residues from a reference sequence, e.g., a naturally occurring CTLA-4 cytoplasmic domain or a CTLA-4 cytoplasmic domain described herein. In embodiments the CTLA-4 cytoplasmic domain of a KIR-CAR differs at no more than 5, 4, 3, 2 or 1 residue from a reference sequence, e.g., a naturally occurring CTLA-4 cytoplasmic domain or a CTLA-4 cytoplasmic domain described herein. In embodiments the CTLA-4 cytoplasmic domain of a KIR-CAR does not differ from, or shares 100% homology with, a reference sequence, e.g., a naturally occurring CTLA-4 cytoplasmic domain or a CTLA-4 cytoplasmic domain described herein.

In an embodiment, an inhNKR-CAR, e.g., an inhKIR-CAR, upon engagement with an antigen on a non-target or bystander cell, inactivates the cytotoxic cell comprising the inhNKR-CAR. While much of the description below relates to inhKIR-CARs, the invention includes the analogous application of other inhNKR-CARs.

In one embodiment, T cells expressing the actKIR-CAR exhibit an antitumor property when bound to its target, whereas T cells expressing an inhKIR-CAR results in inhibition of cell activity when the inhKIR-CAR is bound to its target.

Regardless of the type of KIR-CAR, KIR-CARs are engineered to comprise an extracellular domain having an antigen binding domain fused to a cytoplasmic domain. In one embodiment, KIR-CARs, when expressed in a T cell, are able to redirect antigen recognition based upon the antigen specificity. An exemplary antigen is CD19 because this antigen is expressed on B cell lymphoma. However, CD19 is also expressed on normal B cells, and thus CARs comprising an anti-CD19 domain may result in depletion of normal B cells. Depletion of normal B cells can make a treated subject susceptible to infection, as B cells normally aid T cells in the control of infection. The present invention provides for compositions and methods to limit the depletion of normal tissue during KIR-CAR T cell therapy. In one embodiment, the present invention provides methods to treat cancer and other disorders using KIR-CAR T cell therapy while limiting the depletion of healthy bystander cells.

In one embodiment, the invention comprises controlling or regulating KIR-CAR T cell activity. In one embodiment, the invention comprises compositions and methods related to genetically modifying T cells to express a plurality of types of KIR-CARs, where KIR-CAR T cell activation is dependent on the binding of a plurality of types of KIR-CARs to their target receptor. Dependence on the binding of a plurality of types of KIR-CARs improves the specificity of the lytic activity of the KIR-CAR T cell, thereby reducing the potential for depleting normal healthy tissue.

In another embodiment, the invention comprises compositions and methods related to genetically modifying T cells with an inhibitory KIR-CAR. In one embodiment, the inhibitory KIR-CAR comprises an extracellular antigen binding domain that recognizes an antigen associated with a normal, non-cancerous, cell and an inhibitory cytoplasmic domain.

In one embodiment, the invention provides a dual KIR-CAR where a T cell is genetically modified to express an inhKIR-CAR and an actKIR-CAR. In one embodiment, binding of the inhKIR-CAR to a normal, non-cancerous cell results in the inhibition of the dual KIR-CAR T cell. For example, in one embodiment, binding of the inhKIR-CAR to a normal, non-cancerous cell results in the death of the dual KIR-CAR T cell. In another embodiment, binding of the inhKIR-CAR to a normal, non-cancerous cell results in inhibiting the signal transduction of the actKIR-CAR. In yet another embodiment, binding of the inhKIR-CAR to a normal, non-cancerous cell results in the induction of a signal transduction signal that prevents the actKIR-CAR T cell from exhibiting its anti-tumor activity. Accordingly, the dual KIR-CAR comprising at least one inhKIR-CAR and at least one actKIR-CAR of the invention provides a mechanism to regulate the activity of the dual KIR-CAR T cell.

In one embodiment, the present invention provides methods for treating cancer and other disorders using KIR-CAR T cell therapies while minimizing the depletion of normal healthy tissue. The cancer may be a hematological malignancy, a solid tumor, a primary or a metastasizing tumor. Other diseases treatable using the compositions and methods of the invention include viral, bacterial and parasitic infections as well as autoimmune diseases.

Extracellular Hinge Domain

Extracellular hinge domain, as that term is used herein, refers to a polypeptide sequence of a NKR-CAR disposed between the transmembrane domain and antigen binding domain. In an embodiment the extracellular hinge domain allows sufficient distance from the outer surface of the cell and the antigen binding domain as well as flexibility to minimize steric hinderance between the cell and the antigen binding domain. In an embodiment the extracellular hinge domain is sufficiently short or flexible that it does not interfere with engagement of the cell that includes the NKR-CAR with an antigen bearing cell, e.g., a target cell. In an embodiment the extracellular hinge domain is from 2 to 20, 5 to 15, 7 to 12, or 8 to 10 amino acids in length. In an embodiment the hinge domain includes at least 50, 20, or 10 residues. In embodiments the hinge is 10 to 300, 10 to 250, or 10 to 200 residues in length. In an embodiment the distance from which the hinge extends from the cell is sufficiently short that the hinge does not hinder engagement with the surface of a target cell. In an embodiment the hinge extends less than 20, 15, or 10 nanometers from the surface of the cytotoxic cell. Thus, suitability for a hinge can be influenced by both linear length, the number of amino acid residues and flexibility of the hinge. An IgG4 hinge can be as long as 200 amino acids in length, but the distance it extends from the surface of the cytotoxic cell is smaller due to Ig-domain folding. A CD8alpha hinge, which is ~43 amino acids is rather linear at ~8 nm in length. In contrast, the IgG4 C2 & C3 hinge is ~200 amino acids in length, but has a distance from the cytotoxic cell surface comparable to that of the CD8 alpha hinge. While not wishing to be bound by theory, the similarity in extension is influenced by flexibility.

In some instances, the extracellular hinge domain is, e.g., a hinge from a human protein, a fragment thereof, or a short oligo- or polypeptide linker.

In some embodiments, the hinge is an artificial sequence. In one embodiment, the hinge is a short oligopeptide linker comprising a glycine-serine doublet.

In some embodiments, the hinge is a naturally occurring sequence. In some embodiments, the hinge can be a human Ig (immunoglobulin) hinge, or fragment thereof. In one embodiment, for example, the hinge comprises (e.g., consists of) the amino acid sequence of the IgG4 hinge (SEQ ID NO: 3). In one embodiment, for example, the hinge comprises (e.g., consists of) the amino acid sequence of the IgD hinge (SEQ ID NO: 4). In some embodiments, the hinge can be a human CD8 hinge, or fragment thereof. In one embodiment, for example, the hinge comprises (e.g., consists of) the amino acid sequence of the CD8 hinge (SEQ ID NO: 2). Additional sequences of exemplary hinge domains are provided in Table 5.

TCARS

In some embodiments, the CAR cell therapy of the present invention comprises a NKR-CAR in combination with a TCAR. In embodiments, the CAR cell therapy of the present invention comprises a NKR-CAR-expressing cell described herein further comprises, e.g., expresses, a TCAR. In alternative embodiments, the CAR cell therapy of the present invention comprises a first cell expressing a NKR-CAR described herein and a second cell expressing a TCAR.

In one embodiment, a TCAR comprises an antigen binding domain fused to an intracellular domain, e.g., a cytoplasmic domain. In embodiments, a cytoplasmic domain comprises an intracellular signaling domain and produces an intracellular signal when an extracellular domain, e.g., an antigen binding domain, to which it is fused binds a counter ligand. Intracellular signaling domains can include primary intracellular signaling domains and costimulatory signaling domains. In an embodiment, a TCAR molecule can be constructed for expression in an immune effector cell, e.g., a T cell or NK cell, such that the TCAR molecule comprises a domain, e.g., a primary intracellular signaling domain, a costimulatory signaling domain, an inhibitory domains, etc., that is derived from a polypeptide that is typically associated with the immune cell. For example, a TCAR for expression in an immune effector cell, e.g., a T cell or NK cell, can comprise a 4-1BB domain and a CD3 zeta domain. In this instance, both the 4-1BB and CD3 zeta domains are derived from polypeptides associated with the immune effector cell, e.g., T cell or NK cell. In another embodiment, a TCAR molecule can be constructed for expression in an immune effector cell e.g., a T cell or a NK cell, such that the TCAR molecule comprises a domain that is derived from a polypeptide that is not typically associated with the immune effector cell. Alternatively, a TCAR for expression in a NK cell can comprise a 4-1BB domain and a CD3 zeta domain derived from a T cell (See e.g. WO2013/033626, incorporated herein by reference).

The following sections are relevant to the construction and expression of the NKR-CARs and the TCARs described herein, and methods of use thereof.

Antigen Binding Domain

The CARs described herein, e.g., the KIR-CARs and TCARs described herein, include an antigen binding domain in the extracellular region. An "antigen binding domain" as the term is used herein, refers to a molecule that has affinity for a target antigen, typically an antigen on a target cell, e.g., a cancer cell. An exemplary antigen binding domain comprises a polypeptide, e.g., an antibody molecule (which includes an antibody, and antigen binding fragments thereof, e.g., a immunoglobulin, single domain antibody (sdAb), and an scFv), or a non-antibody scaffold, e.g., a fibronectin, and the like. In embodiments, the antigen binding domain is a single polypeptide. In embodiments, the antigen binding domain comprises, one, two, or more, polypeptides.

The choice of an antigen binding domain can depend upon the type and number of ligands or receptors that define the surface of a target cell. For example, the antigen binding domain may be chosen to recognize a ligand or receptor that acts as a cell surface marker on target cells associated with a particular disease state. Examples of cell surface markers that may act as ligands or receptors include a cell surface marker associated with a particular disease state, e.g., cell surface makers for viral diseases, bacterial diseases parasitic infections, autoimmune diseases and disorders associated with unwanted cell proliferation, e.g., a cancer, e.g., a cancer described herein.

In the context of the present disclosure, "tumor antigen" or "proliferative disorder antigen" or "antigen associated with a proliferative disorder" refers to antigens that are common to specific proliferative disorders. In certain aspects, the proliferative disorder antigens of the present invention are derived from, cancers including but not limited to primary or metastatic melanoma, thymoma, lymphoma, sarcoma, lung cancer (e.g., NSCLC or SCLC), liver cancer, non-Hodgkin's lymphoma, Hodgkin's lymphoma, leukemias, multiple myeloma, glioblastoma, neuroblastoma, uterine cancer, cervical cancer, renal cancer, thyroid cancer, bladder cancer, kidney cancer and adenocarcinomas such as breast cancer, prostate cancer, ovarian cancer, pancreatic cancer, colon cancer and the like. In some embodiments, the cancer is B-cell acute lymphoid leukemia ("BALL"), T-cell acute lymphoid leukemia ("TALL"), acute lymphoid leukemia (ALL), acute myelogenous leukemia (AML); one or more chronic leukemias including but not limited to chronic myelogenous leukemia (CML), chronic lymphocytic leukemia (CLL); additional hematologic cancers or hematologic conditions including, but not limited to B cell prolymphocytic leukemia, blastic plasmacytoid dendritic cell neoplasm, Burkitt's lymphoma, diffuse large B cell lymphoma, follicular lymphoma, hairy cell leukemia, small cell- or a large cell-follicular lymphoma, malignant lymphoproliferative conditions, MALT lymphoma, mantle cell lymphoma, Marginal zone lymphoma, multiple myeloma, myelodysplasia and myelodysplastic syndrome, non-Hodgkin's lymphoma, plasmablastic lymphoma, plasmacytoid dendritic cell neoplasm, Waldenstrom macroglobulinemia, In one embodiment, the tumor antigen comprises one or more antigenic cancer epitopes immunologically recognized by tumor infiltrating lymphocytes (TIL) derived from a cancer tumor of a mammal.

Tumor antigens are proteins that are produced by tumor cells that elicit an immune response, particularly T-cell mediated immune responses. The selection of the antigen binding domain of the invention will depend on the particular type of cancer to be treated. Tumor antigens are well known in the art and include, for example, a tumor antigen described in International Application PCT/US2015/020606. In embodiments, the tumor antigen is chosen from a glioma-associated antigen, carcinoembryonic antigen (CEA), EGFRvIII, Interleukin-11 receptor alpha (IL-11Ra), Interleukin-13 receptor subunit alpha-2 (IL-13Ra or CD213A2), epidermal growth factor receptor (EGFR), B7H3 (CD276), Kit (CD117), carbonic anhydrase (CA-IX), CS-1 (also referred to as CD2 subset 1), Mucin 1, cell surface associated (MUC1), BCMA, oncogene fusion protein consisting of breakpoint cluster region (BCR) and Abelson murine leukemia viral oncogene homolog 1 (Abl) bcr-abl, Receptor tyrosine-protein kinase ERBB2 (HER2/neu), β-human chorionic gonadotropin, alphafetoprotein (AFP), anaplastic lymphoma kinase (ALK), CD19, CD123, cyclin B1, lectin-reactive AFP, Fos-related antigen 1, adrenoceptor beta 3 (ADRB3), thyroglobulin, tyrosinase; ephrin type-A receptor 2 (EphA2), Receptor for Advanced Glycation Endproducts (RAGE-1), renal ubiquitous 1 (RU1), renal ubiquitous 2 (RU2), synovial sarcoma, X breakpoint 2 (SSX2), A kinase anchor protein 4 (AKAP-4), lymphocyte-specific protein tyrosine kinase (LCK), proacrosin binding protein sp32 (OY-TES1), Paired box protein Pax-5 (PAX5), Squamous Cell Carcinoma Antigen Recognized By T Cells 3 (SART3), C-type lectin-like molecule-1 (CLL-1 or CLECL1), fucosyl GM1, hexasaccharide portion of globoH glycoceramide (GloboH), MN-CA IX, Epithelial cell adhesion molecule (EPCAM), EVT6-AML, transglutaminase 5 (TGS5), human telomerase reverse transcriptase (hTERT), polysialic acid, placenta-specific 1 (PLAC1), intestinal carboxyl esterase, LewisY antigen, sialyl Lewis adhesion molecule (sLe), lymphocyte antigen 6 complex, locus K 9 (LY6K), heat shock protein 70-2 mutated (mut hsp70-2), M-CSF, v-myc avian myelocytomatosis viral oncogene neuroblastoma derived homolog (MYCN), Ras Homolog Family Member C (RhoC), Tyrosinase-related protein 2 (TRP-2), Cytochrome P450 1B1 (CYP1B1), CCCTC-Binding Factor (Zinc Finger Protein)-Like (BORIS or Brother of the Regulator of Imprinted Sites), prostase, prostate-specific antigen (PSA), paired box protein Pax-3 (PAX3), prostatic acid phosphatase (PAP), Cancer/testis antigen 1 (NY-ESO-1), Cancer/testis antigen 2 (LAGE-1a), LMP2, neural cell adhesion molecule (NCAM), tumor protein p53 (p53), p53 mutant, Rat sarcoma (Ras) mutant, glycoprotein 100 (gp100), prostein, OR51E2, pannexin 3 (PANX3), prostate-specific membrane antigen (PSMA), prostate stem cell antigen (PSCA), high molecular weight-melanoma-associated antigen (HMWMAA), Hepatitis A virus cellular receptor 1 (HAVCR1), vascular endothelial growth factor receptor 2 (VEGFR2), Platelet-derived growth factor receptor beta (PDGFR-beta), legumain, human papilloma virus E6 (HPV E6), human papilloma virus E7 (HPV E7), survivin, telomerase, sperm protein 17 (SPA17), Stage-specific embryonic antigen-4 (SSEA-4), tyrosinase, TCR Gamma Alternate Reading Frame Protein (TARP), Wilms tumor protein (WT1), prostate-carcinoma tumor antigen-1 (PCTA-1), melanoma inhibitor of apoptosis (ML-IAP), MAGE, Melanoma-associated antigen 1 (MAGE-A1), melanoma cancer testis antigen-1 (MAD-CT-1), melanoma cancer testis antigen-2 (MAD-CT-2), melanoma antigen recognized by T cells 1 (MelanA/MART1), X Antigen Family, Member 1A (XAGE1), elongation factor 2 mutated (ELF2M), ERG (TMPRSS2 ETS fusion gene), N-Acetyl glucosaminyl-transferase V (NA17), neutrophil elastase, sarcoma translocation breakpoints, mammary gland differentiation antigen (NY-BR-1), ephrinB2, CD20, CD22, CD24, CD30, CD33, CD38, CD44v6, CD97, CD171, CD179a, androgen receptor, insulin growth factor (IGF)-I, IGF-II, IGF-I receptor, ganglioside GD2 (GD2), o-acetyl-GD2 ganglioside (OAcGD2), ganglioside GD3 (aNeu5Ac(2-8)aNeu5Ac(2-3) bDGalp(1-4)bDGlcp(1-1)Cer), ganglioside GM3 (aNeu5Ac (2-3)bDGalp(1-4)bDGlcp(1-1)Cer), G protein-coupled receptor class C group 5, member D (GPRC5D), G protein-coupled receptor 20 (GPR20), chromosome X open reading frame 61 (CXORF61), folate receptor (FRa), folate receptor beta, Receptor tyrosine kinase-like orphan receptor 1 (ROR1), Fms-Like Tyrosine Kinase 3 (Flt3), Tumor-associated glycoprotein 72 (TAG72), Tn antigen (TN Ag or (GalNAcα-Ser/Thr)), angiopoietin-binding cell surface receptor 2 (Tie 2), tumor endothelial marker 1 (TEM1 or CD248), tumor endothelial marker 7-related (TEM7R), claudin 6 (CLDN6), thyroid stimulating hormone receptor (TSHR), uroplakin 2 (UPK2), mesothelin, Protease Serine 21 (Testisin or PRSS21), epidermal growth factor receptor (EGFR), fibroblast activation protein alpha (FAP), Olfactory receptor 51E2 (OR51E2), ETS translocation-variant gene 6, located on chromosome 12p (ETV6-AML), CD79a; CD79b; CD72; Leukocyte-associated immunoglobulin-like receptor 1 (LAIR1); Fc fragment of IgA receptor (FCAR or CD89); Leukocyte immunoglobulin-like receptor subfamily A member 2 (LILRA2); CD300 molecule-like family member f (CD300LF); C-type lectin domain family 12 member A (CLEC12A); bone marrow stromal cell antigen 2 (BST2); EGF-like module-containing mucin-like hormone receptor-like 2 (EMR2); lymphocyte antigen 75 (LY75); Glypican-3 (GPC3); Fc receptor-like 5 (FCRL5); and immunoglobulin lambda-like polypeptide 1 (IGLL1). In a preferred embodiment, the tumor antigen is selected from the group consisting of folate receptor (FRa), mesothelin, EGFRvIII, IL-13Ra, CD123, CD19, CD33, BCMA, GD2, CLL-1, CA-IX, MUC1, HER2, and any combination thereof.

In one embodiment, the tumor antigen comprises one or more antigenic cancer epitopes associated with a malignant tumor. Malignant tumors express a number of proteins that can serve as target antigens for an immune attack. These molecules include but are not limited to tissue-specific antigens such as MART-1, tyrosinase and GP 100 in melanoma and prostatic acid phosphatase (PAP) and prostate-specific antigen (PSA) in prostate cancer. Other target antigens include transformation-related molecules such as the oncogene HER-2/Neu/ErbB-2. Yet another group of target antigens are onco-fetal antigens such as carcinoembryonic antigen (CEA). In B-cell lymphoma the tumor-specific idiotype immunoglobulin constitutes a truly tumor-specific immunoglobulin antigen that is unique to the individual tumor. B-cell differentiation antigens such as CD19, CD20 and CD37 are other candidates for target antigens in B-cell lymphoma.

Non-limiting examples of tumor antigens include the following: Differentiation antigens such as MART-1/MelanA (MART-I), gp100 (Pmel 17), tyrosinase, TRP-1, TRP-2 and tumor-specific multilineage antigens such as MAGE-1, MAGE-3, BAGE, GAGE-1, GAGE-2, p15; overexpressed embryonic antigens such as CEA; overexpressed oncogenes and mutated tumor-suppressor genes such as p53, Ras, HER-2/neu; unique tumor antigens resulting from chromosomal translocations; such as BCR-ABL, E2A-PRL, H4-RET, IGH-IGK, MYL-RAR; and viral antigens, such as the Epstein Barr virus antigens EBVA and the human papillomavirus (HPV) antigens E6 and E7. Other large, protein-based antigens include TSP-180, MAGE-4, MAGE-5, MAGE-6, RAGE, NY-ESO, p185erbB2, p180erbB-3, c-met, nm-23H1, PSA, TAG-72, CA 19-9, CA 72-4, CAM 17.1, NuMa, K-ras, beta-Catenin, CDK4, Mum-1, p 15, p 16, 43-9F, 5T4, 791Tgp72, alpha-fetoprotein, beta-HCG, BCA225, BTAA, CA 125, CA 15-3\CA 27.29\BCAA, CA 195, CA 242, CA-50, CAM43, CD68\P1, CO-029, FGF-5, G250, Ga733\EpCAM, HTgp-175, M344, MA-50, MG7-Ag, MOV18, NB/70K, NY-CO-1, RCAS1, SDCCAG16, TA-90\Mac-2 binding protein\cyclophilin C-associated protein, TAAL6, TAG72, TLP, and TPS.

Depending on the desired antigen to be targeted, the CAR of the invention can be engineered to include the appropriate antigen bind domain that is specific to the desired antigen target.

Antigen Binding Domains Derived from an Antibody Molecule

The antigen binding domain can be derived from an antibody molecule, e.g., one or more of monoclonal antibodies, polyclonal antibodies, recombinant antibodies, human antibodies, humanized antibodies, single-domain antibodies e.g., a heavy chain variable domain (VH), a light chain variable domain (VL) and a variable domain (VHH) from, e.g., human or camelid origin. In some instances, it is beneficial for the antigen binding domain to be derived from the same species in which the CAR will ultimately be used in, e.g., for use in humans, it may be beneficial for the antigen binding domain of the CAR, e.g., the KIR-CAR, e.g., described herein, to comprise a human or a humanized antigen binding domain. Antibodies can be obtained using known techniques known in the art.

In certain aspects, the scFv is contiguous with and in the same reading frame as a leader sequence. In one aspect the leader sequence is the amino acid sequence provided as SEQ ID NO:1.

In one aspect, the antigen binding domain is a fragment, e.g., a single chain variable fragment (scFv). In one aspect, the antigen binding domain is a Fv, a Fab, a (Fab')2, or a bi-functional (e.g. bi-specific) hybrid antibody (e.g., Lanzavecchia et al., Eur. J. Immunol. 17, 105 (1987)). In one aspect, the antibodies and fragments thereof of the invention binds a tumor antigen protein or a fragment thereof with wild-type or enhanced affinity.

In some instances, scFvs can be prepared according to method known in the art (see, for example, Bird et al., (1988) Science 242:423-426 and Huston et al., (1988) Proc. Natl. Acad. Sci. USA 85:5879-5883). As described above and elsewhere, scFv molecules can be produced by linking VH and VL chains together using flexible polypeptide linkers. In some embodiments, the scFv molecules comprise flexible polypeptide linker with an optimized length and/or amino acid composition. The flexible polypeptide linker length can greatly affect how the variable regions of a scFv fold and interact. In fact, if a short polypeptide linker is employed (e.g., between 5-10 amino acids, intrachain folding is prevented. Interchain folding is also required to bring the two variable regions together to form a functional epitope binding site. For examples of linker orientation and size see, e.g., Hollinger et al. 1993 Proc Natl Acad. Sci. U.S.A. 90:6444-6448, U.S. Patent Application Publication Nos. 2005/0100543, 2005/0175606, 2007/0014794, and PCT publication Nos. WO2006/020258 and WO2007/024715, is incorporated herein by reference.

An scFv can comprise a linker of at least 1, 2, 3, 4, 5, 6, 7, 8, 9, 10, 11, 12, 13, 14, 15, 16, 17, 18, 19, 20, 25, 30, 35, 40, 45, 50, or more amino acid residues between its VL and VH regions. The linker sequence may comprise any naturally occurring amino acid. In one embodiment, the peptide linker of the scFv consists of amino acids such as glycine and/or serine residues used alone or in combination, to link variable heavy and variable light chain regions together. In one embodiment, the flexible polypeptide linker is a Gly/Ser linker and, e.g., comprises the amino acid sequence (Gly-Gly-Gly-Ser)n, where n is a positive integer equal to or greater than 1 (SEQ ID NO: 40). For example, n=1, n=2, n=3. n=4, n=5 and n=6, n=7, n=8, n=9 and n=10. In one embodiment, the flexible polypeptide linkers include, but are not limited to, (Gly4 Ser)4 (SEQ ID NO: 27) or (Gly4 Ser)3 (SEQ ID NO: 28). In another embodiment, the linkers include multiple repeats of (Gly2Ser), (GlySer) or (Gly3Ser) (SEQ ID NO: 29).

In some embodiments, the antigen binding domain is a single domain antigen binding (SDAB) molecules. A SDAB molecule includes molecules whose complementary determining regions are part of a single domain polypeptide. Examples include, but are not limited to, heavy chain variable domains, binding molecules naturally devoid of light chains, single domains derived from conventional 4-chain antibodies, engineered domains and single domain scaffolds other than those derived from antibodies (e.g., described in more detail below). SDAB molecules may be any of the art, or any future single domain molecules. SDAB molecules may be derived from any species including, but not limited to mouse, human, camel, llama, fish, shark, goat, rabbit, and bovine. This term also includes naturally occurring single domain antibody molecules from species other than *Camelidae* and sharks.

In one aspect, an SDAB molecule can be derived from a variable region of the immunoglobulin found in fish, such as, for example, that which is derived from the immunoglobulin isotype known as Novel Antigen Receptor (NAR) found in the serum of shark. Methods of producing single domain molecules derived from a variable region of NAR ("IgNARs") are described in WO 03/014161 and Streltsov (2005) *Protein Sci.* 14:2901-2909.

According to another aspect, an SDAB molecule is a naturally occurring single domain antigen binding molecule known as a heavy chain devoid of light chains. Such single domain molecules are disclosed in WO 9404678 and Hamers-Casterman, C. et al. (1993) *Nature* 363:446-448, for example. For clarity reasons, this variable domain derived from a heavy chain molecule naturally devoid of light chain is known herein as a VHH or nanobody to distinguish it from the conventional VH of four chain immunoglobulins. Such a VHH molecule can be derived from *Camelidae* species, for example in camel, llama, dromedary, alpaca and guanaco. Other species besides *Camelidae* may produce heavy chain molecules naturally devoid of light chain; such VHHs are within the scope of the invention.

In certain embodiments, the SDAB molecule is a single chain fusion polypeptide comprising one or more single domain molecules (e.g., nanobodies), devoid of a complementary variable domain or an immunoglobulin constant, e.g., Fc, region, that binds to one or more target antigens.

The SDAB molecules can be recombinant, CDR-grafted, humanized, camelized, de-immunized and/or in vitro generated (e.g., selected by phage display).

In one embodiment, the antigen biding domain portion comprises a human antibody or a fragment thereof.

In some embodiments, a non-human antibody is humanized, where specific sequences or regions of the antibody are modified to increase similarity to an antibody naturally produced in a human. In an embodiment, the antigen binding domain is humanized.

Non human antibodies can be humanized using a variety of techniques known in the art, e.g., CDR-grafting (see, e.g., European Patent No. EP 239,400; International Publication No. WO 91/09967; and U.S. Pat. Nos. 5,225,539, 5,530,101, and 5,585,089, each of which is incorporated herein in its entirety by reference), veneering or resurfacing (see, e.g., European Patent Nos. EP 592,106 and EP 519,596; Padlan, 1991, Molecular Immunology, 28(4/5):489-498; Studnicka et al., 1994, Protein Engineering, 7(6):805-814; and Roguska et al., 1994, PNAS, 91:969-973, each of which is incorporated herein by its entirety by reference), chain shuffling (see, e.g., U.S. Pat. No. 5,565,332, which is incorporated herein in its entirety by reference), and techniques disclosed in, e.g., U.S. Patent Application Publication No. US2005/0042664, U.S. Patent Application Publication No. US2005/0048617, U.S. Pat. Nos. 6,407,213, 5,766,886, International Publication No. WO 9317105, Tan et al., 2002, J. Immunol., 169:1119-25; Caldas et al., 2000, Protein Eng., 13(5):353-60; Morea et al., 2000, Methods, 20:267-79; Baca et al., 1997, J. Biol. Chem., 272:10678-84; Roguska et al., 1996, Protein Eng., 9(10):895-904; Couto et al., 1995, Cancer Res., 55:5973s-5977; Couto et al., 1995, Cancer Res., 55(8):1717-22; Sandhu 1994 Gene, 150(2):409-10; and Pedersen et al., 1994, J. Mol. Biol., 235(3):959-73, each of which is incorporated herein in its entirety by reference. Often, framework residues in the framework regions will be substituted with the corresponding residue from the CDR donor antibody to alter, for example improve, antigen binding. These framework substitutions are identified by methods well-known in the art, e.g., by modeling of the interactions of the CDR and framework residues to identify framework residues important for antigen binding and sequence comparison to identify unusual framework residues at particular positions. (See, e.g., Queen et al., U.S. Pat. No. 5,585,089; and Riechmann et al., 1988, Nature, 332: 323, which are incorporated herein by reference in their entireties.). In preferred embodiments, the humanized antibody molecule comprises a sequence described herein, e.g., a variable light chain and/or a variable heavy chain described herein, e.g., a humanized variable light chain and/or variable heavy chain described in Table 4.

A humanized antibody has one or more amino acid residues introduced into it from a source which is nonhuman. These nonhuman amino acid residues are often referred to as "import" residues, which are typically taken from an "import" variable domain. Thus, humanized antibodies comprise one or more CDRs from nonhuman immunoglobulin molecules and framework regions from human.

Humanization of antibodies is well-known in the art and can essentially be performed following the method of Winter and co-workers (Jones et al., Nature, 321:522-525 (1986); Riechmann et al., Nature, 332:323-327 (1988); Verhoeyen et al., Science, 239:1534-1536 (1988)), by substituting rodent CDRs or CDR sequences for the corresponding sequences of a human antibody, i.e., CDR-grafting (EP 239,400; PCT Publication No. WO 91/09967; and U.S. Pat. Nos. 4,816, 567; 6,331,415; 5,225,539; 5,530,101; 5,585,089; 6,548, 640, the contents of which are incorporated herein by reference herein in their entirety). In such humanized chimeric antibodies, substantially less than an intact human variable domain has been substituted by the corresponding sequence from a nonhuman species. In practice, humanized antibodies are typically human antibodies in which some CDR residues and possibly some framework (FR) residues are substituted by residues from analogous sites in rodent antibodies. Humanization of antibodies can also be achieved by veneering or resurfacing (EP 592,106; EP 519,596; Padlan, 1991, Molecular Immunology, 28(4/5):489-498; Studnicka et al., Protein Engineering, 7(6):805-814 (1994); and Roguska et al., PNAS, 91:969-973 (1994)) or chain shuffling (U.S. Pat. No. 5,565,332), the contents of which are incorporated herein by reference herein in their entirety.

In some embodiments, the antibody of the invention is further prepared using an antibody having one or more of the VH and/or VL sequences disclosed herein can be used as starting material to engineer a modified antibody, which modified antibody may have altered properties as compared to the starting antibody. In various embodiments, the antibody is engineered by modifying one or more amino acids within one or both variable regions (i.e., VH and/or VL), for example within one or more CDR regions and/or within one or more framework regions.

In another aspect, the antigen binding domain is a T cell receptor ("TCR"), or a fragment thereof, for example, a single chain TCR (scTCR). Methods to make such TCRs is known in the art. See, e.g., Willemsen R A et al, Gene Therapy 7: 1369-1377 (2000); Zhang T et al, Cancer Gene Ther 11: 487-496 (2004); Aggen et al, Gene Ther. 19(4): 365-74 (2012) (references are incorporated herein by its entirety). For example, scTCR can be engineered that contains the Vα and Vβ genes from a T cell clone linked by a linker (e.g., a flexible peptide). This approach is very useful to cancer associated target that itself is intracellular, however, a fragment of such antigen (peptide) is presented on the surface of the cancer cells by MHC.

In embodiments, a NKR-CAR or TCAR molecule described herein comprises an antigen binding domain comprising a scFv that specifically binds to a tumor antigen described herein. Amino acid sequences of scFvs that specifically bind to tumor antigens described herein are provided in Table 4. In some embodiments, the CDRs of the scFv sequences provided in Table 4 are underlined. The precise amino acid sequence boundaries of a given CDR can be determined using any of a number of well-known numbering schemes, including those described by Kabat or Chothia, or a combination of Kabat and Chothia numbering schemes.

The scFv sequences provided in Table 4 comprise a linker sequence that join the variable heavy and variable light chains of the scFvs. The linker sequence can be any of the linker sequences described herein, e.g., a linker sequence provided in Table 5.

It is also noted that some of the scFv sequences provided in Table 4 further comprise a leader sequence, e.g., an amino acid sequence of SEQ ID NO: 1, while some of the scFv sequences provided in Table 4 do not comprise a leader sequence, e.g., an amino acid sequence of SEQ ID NO: 1. The scFv sequences provided in Table 4 with or without a leader sequence, e.g., SEQ ID NO: 1, are also encompassed in the invention. The ordinary skilled artisan could readily use the sequences provided in Table 4 to generate scFvs or antigen binding domains of a CAR with or without a leader sequence, e.g., an amino acid sequence of SEQ ID NO: 1.

TABLE 4

Exemplary Antigen Binding Domains

| Target Antigen | Name | Amino Acid Sequence | SEQ ID NO: |
|---|---|---|---|
| CD19 | huscFv1 | EIVMTQSPATLSLSPGERATLSCRASQDISKYLNWYQQKPGQAPRLLIYHTSRLH SGIPARFSGSGSGTDYTLTISSLQPEDFAVYFCQQGNTLPYTFGQGTKLEIKGGG GSGGGGSGGGGSQVQLQESGPGLVKPSETLSLTCTVSGVSLPDYGVSWIRQPPGK GLEWIGVIWGSETTYYSSSLKSRVTISKDNSKNQVSLKLSSVTAADTAVYYCAKH YYYGGSYAMDYWGQGTLVTVSS | 161 |
| CD19 | huscFv2 | Eivmtqspatlslspgeratlscrasqdiskylnwyqqkpgqaprlliyhtsrlh sgiparfsgsgsgtdytltisslqpedfavyfcqqgntlpytfgqgtkleikggg gsggggsggggsqvqlqesgpglvkpsetlsltctvsgvslpdygvswirqppgk glewigviwgsettyyqsslksrvtiskdnsknqvslklssvtaadtavyycakh yyyggsyamdywgqgtlvtvss | 162 |
| CD19 | huscFv3 | Qvqlqesgpglvkpsetlsltctvsgvslpdygvswirqppgkglewigviwgse ttyyssslksrvtiskdnsknqvslklssvtaadtavyycakhyyyggsyamdyw gqgtlvtvssggggsggggsggggseivmtqspatlslspgeratlscrasqdis kylnwyqqkpgqaprlliyhtsrlhsgiparfsgsgsgtdytltisslqpedfav yfcqqgntlpytfgqgtkleik | 163 |
| CD19 | huscFv4 | Qvqlqesgpglvkpsetlsltctvsgvslpdygvswirqppgkglewigviwgse ttyyqsslksrvtiskdnsknqvslklssvtaadtavyycakhyyyggsyamdyw gqgtlvtvssggggsggggsggggseivmtqspatlslspgeratlscrasqdis kylnwyqqkpgqaprlliyhtsrlhsgiparfsgsgsgtdytltisslqpedfav yfcqqgntlpytfgqgtkleik | 164 |
| CD19 | huscFv5 | Eivmtqspatlslspgeratlscrasqdiskylnwyqqkpgqaprlliyhtsrlh sgiparfsgsgsgtdytltisslqpedfavyfcqqgntlpytfgqgtkleikggg gsggggsggggsggggsqvqlqesgpglvkpsetlsltctvsgvslpdygvswir qppgkglewigviwgsettyyssslksrvtiskdnsknqvslklssvtaadtavy ycakhyyyggsyamdywgqgtlvtvss | 165 |
| CD19 | huscFv6 | Eivmtqspatlslspgeratlscrasqdiskylnwyqqkpgqaprlliyhtsrlh sgiparfsgsgsgtdytltisslqpedfavyfcqqgntlpytfgqgtkleikggg gsggggsggggsggggsqvqlqesgpglvkpsetlsltctvsgvslpdygvswir qppgkglewigviwgsettyyqsslksrvtiskdnsknqvslklssvtaadtavy ycakhyyyggsyamdywgqgtlvtvss | 166 |
| CD19 | huscFv7 | Qvqlqesgpglvkpsetlsltctvsgvslpdygvswirqppgkglewigviwgse ttyyssslksrvtiskdnsknqvslklssvtaadtavyycakhyyyggsyamdyw gqgtlvtvssggggsggggsggggsggggseivmtqspatlslspgeratlscra sqdiskylnwyqqkpgqaprlliyhtsrlhsgiparfsgsgsgtdytltisslqp edfavyfcqqgntlpytfgqgtkleik | 167 |
| CD19 | huscFv8 | Qvqlqesgpglvkpsetlsltctvsgvslpdygvswirqppgkglewigviwgse ttyyqsslksrvtiskdnsknqvslklssvtaadtavyycakhyyyggsyamdyw gqgtlvtvssggggsggggsggggsggggseivmtqspatlslspgeratlscra sqdiskylnwyqqkpgqaprlliyhtsrlhsgiparfsgsgsgtdytltisslqp edfavyfcqqgntlpytfgqgtkleik | 168 |
| CD19 | huscFv9 | Eivmtqspatlslspgeratlscrasqdiskylnwyqqkpgqaprlliyhtsrlh sgiparfsgsgsgtdytltisslqpedfavyfcqqgntlpytfgqgtkleikggg gsggggsggggsggggsqvqlqesgpglvkpsetlsltctvsgvslpdygvswir qppgkglewigviwgsettyynsslksrvtiskdnsknqvslklssvtaadtavy ycakhyyyggsyamdywgqgtlvtvss | 169 |
| CD19 | Hu scFv10 | Qvqlqesgpglvkpsetlsltctvsgvslpdygvswirqppgkglewigviwgse ttyynsslksrvtiskdnsknqvslklssvtaadtavyycakhyyyggsyamdyw gqgtlvtvssggggsggggsggggsggggseivmtqspatlslspgeratlscra sqdiskylnwyqqkpgqaprlliyhtsrlhsgiparfsgsgsgtdytltisslqp edfavyfcqqgntlpytfgqgtkleik | 170 |
| CD19 | Hu scFv11 | Eivmtqspatlslspgeratlscrasqdiskylnwyqqkpgqaprlliyhtsrlh sgiparfsgsgsgtdytltisslqpedfavyfcqqgntlpytfgqgtkleikggg gsggggsggggsqvqlqesgpglvkpsetlsltctvsgvslpdygvswirqppgk glewigviwgsettyynsslksrvtiskdnsknqvslklssvtaadtavyycakh yyyggsyamdywgqgtlvtvss | 171 |

TABLE 4-continued

Exemplary Antigen Binding Domains

| Target Antigen | Name | Amino Acid Sequence | SEQ ID NO: |
|---|---|---|---|
| CD19 | Hu scFv12 | Qvqlqesgpglvkpsetlsltctvsgvslpdygvswirqppgkglewigviwgse ttyynsslksrvtiskdnsknqvslklssvtaadtavyycakhyyyggsyamdyw gqgtlvtvssggggsggggsggggseivmtqspatlslspgeratlscrasqdis kylnwyqqkpgqaprlliyhtsrlhsgiparfsgsgsgtdytltisslqpedfav yfcqqgntlpytfgqgtkleik | 172 |
| CD19 | muCTL019 | Diqmtqttsslsaslgdrvtiscrasqdiskylnwyqqkpdgtvklliyhtsrlh sgvpsrfsgsgsgtdysltisnleqediatyfcqqgntlpytfgggtkleitggg gsggggsggggsevklqesgpglvapsqslsvtctvsgvslpdygvswirqpprk glewlgviwgsettyynsalksrltiikdnsksqvflkmnslqtddtaiyycakh yyyggsyamdywgqgtsvtvss | 173 |
| CD123 | Mu1172 | DIVLTQSPASLAVSLGQRATISCRASESVDNYGNTFMHWYQQKPGQPPKL LIYRASNLESGIPARFSGSGSRTDFTLTINPVEADDVATYYCQQSNEDPPTF GAGTKLELKGGGGSGGGGSSGGGSQIQLVQSGPELKKPGETVKISCKASG YIFTNYGMNWVKQAPGKSFKWMGWINTYTGESTYSADFKGRFAFSLETS ASTAYLHINDLKNEDTATYFCARSGGYDPMDYWGQGTSVTVSS | 174 |
| CD123 | Mu1176 | DVQITQSPSYLAASPGETITINCRASKSISKDLAWYQEKPGKTNKLLIYSGS TLQSGIPSRFSGSGSGTDFTLTISSLEPEDFAMYYCQQHNKYPYTFGGGTK LEIKGGGGSGGGGSSGGGSQVQLQQPGAELVRPGASVKLSCKASGYTFTS YWMNWVKQRPDQGLEWIGRIDPYDSETHYNQKFKDKAILTVDKSSSTAY MQLSSLTSEDSAVYYCARGNWDDYWGQGTTLTVSS | 175 |
| CD123 | huscFv1 | Divltqspdslavslgeratincrasesvdnygntfmhwyqqkpgqppklliyrasnlesgvpdrfsgsgsrtdftl tisslqaedvavyycqqsnedpptfgqgtkleikggggsggggsggggsggggsqiqlvqsgselkkpgasvkv sckasgyiftnygmnwvrqapgqglewmgwintytgestysadfkgrfvfsldtsvstaylqinalkaedtavy ycarsggydpmdywgqgttvtvss | 176 |
| CD123 | huscFv2 | Divltqspdslavslgeratincrasesvdnygntfmhwyqqkpgqppklliyrasnlesgvpdrfsgsgsrtdftl tisslqaedvavyycqqsnedpptfgqgtkleikggggsggggsggggsggggsqiqlvqsgaevkkpgasvk vsckasgyiftnygmnwvrqapgqrlewmgwintytgestysadfkgrvtitldtsastaymelsslrsedtavy ycarsggydpmdywgqgttvtvss | 177 |
| CD123 | huscFv3 | Eivltqspatlslspgeratlscrasesvdnygntfmhwyqqkpgqaprlliyrasnlesgiparfsgsgsrtdftl tisslepedvavyycqqsnedpptfgqgtkleikggggsggggsggggsggggsqiqlvqsgselkkpgasvkvsc kasgyiftnygmnwvrqapgqglewmgwintytgestysadfkgrfvfsldtsvstaylqinalkaedtavyyc arsggydpmdywgqgttvtvss | 178 |
| CD123 | huscFv4 | Eivltqspatlslspgeratlscrasesvdnygntfmhwyqqkpgqaprlliyrasnlesgiparfsgsgsrtdftl tisslepedvavyycqqsnedpptfgqgtkleikggggsggggsggggsggggsqiqlvqsgaevkkpgasvks ckasgyiftnygmnwvrqapgqrlewmgwintytgestysadfkgrvtitldtsastaymelsslrsedtavyyc arsggydpmdywgqgttvtvss | 179 |
| CD123 | huscFv5 | Qiqlvqsgselkkpgasvkvsckasgyiftnygmnwvrqapgqglewmgwintytgestysadfkgrfvfsl dtsvstaylqinalkaedtavyycarsggydpmdywgqgttvtvssggggsggggsggggsggggsdivltqs pdslavslgeratincrasesvdnygntfmhwyqqkpgqppklliyrasnlesgvpdrfsgsgsrtdftltissl qaedvavyycqqsnedpptfgqgtkleik | 180 |
| CD123 | huscFv6 | Qiqlvqsgselkkpgasvkvsckasgyiftnygmnwvrqapgqglewmgwintytgestysadfkgrfvfsl dtsvstaylqinalkaedtavyycarsggydpmdywgqgttvtvssggggsggggsggggsggggseivltqsp atlslspgeratlscrasesvdnygntfmhwyqqkpgqaprlliyrasnlesgiparfsgsgsrtdftltisslep edvavyycqqsnedpptfgqgtkleik | 181 |
| CD123 | huscFv7 | Qiqlvqsgaevkkpgasvkvsckasgyiftnygmnwvrqapgqrlewmgwintytgestysadfkgrvtitld tsastaymelsslrsedtavyycarsggydpmdywgqgttvtvssggggsggggsggggsggggsdivltqsp dslavslgeratincrasesvdnygntfmhwyqqkpgqppklliyrasnlesgvpdrfsgsgsrtdftltisslq aedvavyycqqsnedpptfgqgtkleik | 182 |
| CD123 | huscFv8 | Qiqlvqsgaevkkpgasvkvsckasgyiftnygmnwvrqapgqrlewmgwintytgestysadfkgrvtitld tsastaymelsslrsedtavyycarsggydpmdywgqgttvtvssggggsggggsggggsggggseivltqspa tlslspgeratlscrasesvdnygntfmhwyqqkpgqaprlliyrasnlesgiparfsgsgsrtdftltisslep edvavyycqqsnedpptfgqgtkleik | 183 |
| CD123 | Human 123-1 | MALPVTALLLPLALLLHAARPQVQLVQSGAEVKKPGASVKVSCKAS<u>GYTFTGYYMH</u>WVRQA PGQGLEWMG<u>WINPNSGGTNYAQKFQG</u>RVTMTRDTSISTAYMELSRLRSDDTAVYYCARD<u>MN ILATVPFDI</u>WGQGTMVTVSSGGGGSGGGGSGGGGSDIQMTQSPSSLSASVGDRVTITC<u>RAS QSISTYLN</u>WYQQKPGKAPNLLIY<u>AAFSLQS</u>GVPSRFSGSGSGTDFTLTINSLQPEDFATYY C<u>QQGDSVPLT</u>FGGGTKLEIK | 184 |
| CD123 | Human 123-2 | MALPVTALLLPLALLLHAARPQVQLVQSGAEVKKPGASVKVSCKAS<u>GYTFTGYYMH</u>WVRQA PGQGLEWMG<u>WINPNSGGTNYAQKFQG</u>RVTLTRDTSISTVYMELSRLRSDDTAVYYCARD<u>MN ILATVPFDI</u>WGQGTMVTVSSGGGGSGGGGSGGGGSDIQMTQSPSSLSASVGDRVTITC<u>RAS</u> | 185 |

TABLE 4-continued

Exemplary Antigen Binding Domains

| Target Antigen | Name | Amino Acid Sequence | SEQ ID NO: |
|---|---|---|---|
| | | <u>QSISSYLN</u>WYQQKPGKAPKLLIY<u>AASSLQS</u>GVPSRFSGSGSGTDFTLTVNSLQPEDFATYY C<u>QQGDSVPLT</u>FGGGTRLEIK | |
| CD123 | Human 123-3 | MALPVTALLLPLALLLHAARPQVQLVQSGAEVKKPGASVKVSCKASGYIFTGYYIHWVRQA PGQGLEWMG<u>WINPNSGGTNYAQKFQ</u>GRVTMTRDTSISTAYMELSGLRSDDPAVYYCARD<u>MN ILATVPFDI</u>WGQGTLVTVSSGGGGSGGGGSGGGGSDIQLTQSPSSLSASVGDRVTITCR<u>AS QSISSYLN</u>WYQQKPGKAPKLLIY<u>AASSLQS</u>GVPSRFSGSGSGTDFTLTVNSLQPEDFATYY C<u>QQGDSVPLT</u>FGGGTKVEIK | 186 |
| CD123 | Human 123-4 | MALPVTALLLPLALLLHAARPQVQLQQSGAEVKKSGASVKVSCKAS<u>GYTFTDYYMH</u>WLRQA PGQGLEWMG<u>WINPNSGDTNYAQKFQ</u>GRVTMTRDTSISTVYMELSRLRSDDTAVYYCARD<u>MN ILATVPFDI</u>WGQGTMVTVSSASGGGGSGGRASGGGGSDIQMTQSPSSLSASVGDRVTITCR <u>ASQSISSYLN</u>WYQQKPGKAPKLLIY<u>AASSLQS</u>GVPSRFSGSGSGTDFTLTISSLQPEDFAT YYC<u>QQGDSVPLT</u>FGGGTKVEIK | 187 |
| CD123 | hzCAR-1 | MALPVTALLLPLALLLHAARPQVQLVQSGAEVKKPGASVKVSCKAS<u>GYTFTSYWMN</u>WVRQA PGQGLEWMG<u>RIDPYDSETHYNQKFKD</u>RVTMTVDKSTSTAYMELSSLRSEDTAVYYCAR<u>GNW DDY</u>WGQGTTVTVSSGGGGSGGGGSGGGGSGGGGSDVQLTQSPSFLSASVGDRVTITCR<u>ASK SISKDLA</u>WYQQKPGKAPKLLIY<u>SGSTLQS</u>GVPSRFSGSGSGTEFTLTISSLQPEDFATYYC <u>QQHNKYPYT</u>FGGGTKVEIK | 188 |
| CD123 | hzCAR-2 | MALPVTALLLPLALLLHAARPQVQLVQSGAEVKKPGASVKVSCKAS<u>GYTFTSYWMN</u>WVRQ APGQGLEWMG<u>RIDPYDSETHYNQKFKD</u>RVTMTVDKSTSTAYMELSSLRSEDTAVYYCARG <u>NWDDY</u>WGQGTTVTVSSGGGGSGGGGSGGGGSGGGGSEVVLTQSPATLSLSPGERATLSCR <u>ASKSISKDLA</u>WYQQKPGQAPRLLIY<u>SGSTLQS</u>GIPARFSGSGSGTDFTLTISSLEPEDFA VYYC<u>QQHNKYPYT</u>FGGGTKVEIK | 189 |
| CD123 | hzCAR-3 | MALPVTALLLPLALLLHAARPQVQLVQSGAEVKKPGASVKVSCKAS<u>GYTFTSYWMN</u>WVRQ APGQGLEWMG<u>RIDPYDSETHYNQKFKD</u>RVTMTVDKSTSTAYMELSSLRSEDTAVYYCARG <u>NWDDY</u>WGQGTTVTVSSGGGGSGGGGSGGGGSGGGGSDVVMTQSPAFLSVTPGEKVTITCR <u>ASKSISKDLA</u>WYQQKPDQAPKLLIY<u>SGSTLQS</u>GVPSRFSGSGSGTDFTFTISSLEAEDAA TYYC<u>QQHNKYPYT</u>FGGGTKVEIK | 190 |
| CD123 | hzCAR-4 | MALPVTALLLPLALLLHAARPQVQLVQSGAEVKKPGASVKVSCKAS<u>GYTFTSYWMN</u>WVRQ APGQGLEWMG<u>RIDPYDSETHYNQKFKD</u>RVTMTVDKSTSTAYMELSSLRSEDTAVYYCARG <u>NWDDY</u>WGQGTTVTVSSGGGGSGGGGSGGGGSGGGGSDVVMTQSPDSLAVSLGERATINCR <u>ASKSISKDLA</u>WYQQKPGQPPKLLIY<u>SGSTLQS</u>GVPDRFSGSGSGTDFTLTISSLQAEDVA VYYC<u>QQHNKYPYT</u>FGGGTKVEIK | 191 |
| CD123 | hzCAR-5 | MALPVTALLLPLALLLHAARPDVQLTQSPSFLSASVGDRVTITCR<u>ASKSISKDLA</u>WYQQK PGKAPKLLIY<u>SGSTLQS</u>GVPSRFSGSGSGTEFTLTISSLQPEDFATYYC<u>QQHNKYPYT</u>FG GGTKVEIKGGGGSGGGGSGGGGSGGGGSQVQLVQSGAEVKKPGASVKVSCKAS<u>GYTFTSY WMN</u>WVRQAPGQGLEWMG<u>RIDPYDSETHYNQKFKD</u>RVTMTVDKSTSTAYMELSSLRSEDTA VYYCAR<u>GNWDDY</u>WGQGTTVTVSS | 192 |
| CD123 | hzCAR-6 | MALPVTALLLPLALLLHAARPEVVLTQSPATLSLSPGERATLSCR<u>ASKSISKDLA</u>WYQQK PGQAPRLLIY<u>SGSTLQS</u>GIPARFSGSGSGTDFTLTISSLEPEDFAVYYC<u>QQHNKYPYT</u>FG GGTKVEIKGGGGSGGGGSGGGGSGGGGSQVQLVQSGAEVKKPGASVKVSCKAS<u>GYTFTSY WMN</u>WVRQAPGQGLEWMG<u>RIDPYDSETHYNQKFKD</u>RVTMTVDKSTSTAYMELSSLRSEDTA VYYCAR<u>GNWDDY</u>WGQGTTVTVSS | 193 |
| CD123 | hzCAR-7 | MALPVTALLLPLALLLHAARPDVVMTQSPAFLSVTPGEKVTITCR<u>ASKSISKDLA</u>WYQQK PDQAPKLLIY<u>SGSTLQS</u>GVPSRFSGSGSGTDFTFTISSLEAEDAATYYC<u>QQHNKYPYT</u>FG GGTKVEIKGGGGSGGGGSGGGGSGGGGSQVQLVQSGAEVKKPGASVKVSCKAS<u>GYTFTSY WMN</u>WVRQAPGQGLEWMG<u>RIDPYDSETHYNQKFKD</u>RVTMTVDKSTSTAYMELSSLRSEDTA VYYCAR<u>GNWDDY</u>WGQGTTVTVSS | 194 |
| CD123 | hzCAR-8 | MALPVTALLLPLALLLHAARPDVVMTQSPDSLAVSLGERATINCR<u>ASKSISKDLA</u>WYQQK PGQPPKLLIY<u>SGSTLQS</u>GVPDRFSGSGSGTDFTLTISSLQAEDVAVYYC<u>QQHNKYPYT</u>FG GGTKVEIKGGGGSGGGGSGGGGSGGGGSQVQLVQSGAEVKKPGASVKVSCKAS<u>GYTFTSY WMN</u>WVRQAPGQGLEWMG<u>RIDPYDSETHYNQKFKD</u>RVTMTVDKSTSTAYMELSSLRSEDTA VYYCAR<u>GNWDDY</u>WGQGTTVTVSS | 195 |
| CD123 | hzCAR-9 | MALPVTALLLPLALLLHAARPQVQLVQSGSELKKPGASVKVSCKAS<u>GYTFTSYWMN</u>WVRQ APGQGLEWMG<u>RIDPYDSETHYNQKFKD</u>RVFSVDKSVSTAYLISSLKAEDTAVYYCARG <u>NWDDY</u>WGQGTTVTVSSGGGGSGGGGSGGGGSGGGGSDVQLTQSPSFLSASVGDRVTITCR <u>ASKSISKDLA</u>WYQQKPGKAPKLLIY<u>SGSTLQS</u>GVPSRFSGSGSGTEFTLTISSLQPEDFA TYYC<u>QQHNKYPYT</u>FGGGTKVEIK | 196 |
| CD123 | hzCAR-10 | MALPVTALLLPLALLLHAARPQVQLVQSGSELKKPGASVKVSCKAS<u>GYTFTSYWMN</u>WVRQ APGQGLEWMG<u>RIDPYDSETHYNQKFKD</u>RVFSVDKSVSTAYLQISSLKAEDTAVYYCARG <u>NWDDY</u>WGQGTTVTVSSGGGGSGGGGSGGGGSGGGGSEVVLTQSPATLSLSPGERATLSCR <u>ASKSISKDLA</u>WYQQKPGQAPRLLIY<u>SGSTLQS</u>GIPARFSGSGSGTDFTLTISSLEPEDFA VYYC<u>QQHNKYPYT</u>FGGGTKVEIK | 197 |

TABLE 4-continued

Exemplary Antigen Binding Domains

| Target Antigen | Name | Amino Acid Sequence | SEQ ID NO: |
|---|---|---|---|
| CD123 | hzCAR-11 | MALPVTALLLPLALLLHAARPQVQLVQSGSELKKPGASVKVSCKAS<u>GYTFTSYWMN</u>WVRQ APGQGLEWMG<u>RIDPYDSETHYNQKFKD</u>RFVFSVDKSVSTAYLQISSLKAEDTAVYYCAR<u>G NWDDY</u>WGQGTTVTVSSGGGGSGGGGSGGGGSGGGGSDVVMTQSPAFLSVTPGEKVTITC<u>R ASKSISKDLA</u>WYQQKPDQAPKLLIY<u>SGSTLQS</u>GVPSRFSGSGSGTDFTFTISSLEAEDAA TYYC<u>QQHNKYPYT</u>FGGGTKVEIK | 198 |
| CD123 | hzCAR-12 | MALPVTALLLPLALLLHAARPQVQLVQSGSELKKPGASVKVSCKAS<u>GYTFTSYWMN</u>WVRQ APGQGLEWMG<u>RIDPYDSETHYNQKFKD</u>RFVFSVDKSVSTAYLQISSLKAEDTAVYYCAR<u>G NWDDY</u>WGQGTTVTVSSGGGGSGGGGSGGGGSGGGGSDVVMTQSPDSLAVSLGERATINC<u>R ASKSISKDLA</u>WYQQKPGQPPKLLIY<u>SGSTLQS</u>GVPDRFSGSGSGTDFTLTISSLQAEDVA VYYC<u>QQHNKYPYT</u>FGGGTKVEIK | 199 |
| CD123 | hzCAR-13 | MALPVTALLLPLALLLHAARPDVQLTQSPSFLSASVGDRVTITC<u>RASKSISKDLA</u>WYQQK PGKAPKLLIY<u>SGSTLQS</u>GVPSRFSGSGSGTEFTLTISSLQPEDFATYYC<u>QQHNKYPYT</u>FG GGTKVEIKGGGGSGGGGSGGGGSGGGGSQVQLVQSGSELKKPGASVKVSCKAS<u>GYTFTSY WMN</u>WVRQAPGQGLEWMG<u>RIDPYDSETHYNQKFKD</u>RFVFSVDKSVSTAYLQISSLKAEDTA VYYCAR<u>GNWDDY</u>WGQGTTVTVSS | 200 |
| CD123 | hzCAR-14 | MALPVTALLLPLALLLHAARPEVVLTQSPATLSLSPGERATLSC<u>RASKSISKDLA</u>WYQQK PGQAPRLLIY<u>SGSTLQS</u>GIPARFSGSGSGTDFTLTISSLEPEDFAVYYC<u>QQHNKYPYT</u>FG GGTKVEIKGGGGSGGGGSGGGGSGGGGSQVQLVQSGSELKKPGASVKVSCKAS<u>GYTFTSY WMN</u>WVRQAPGQGLEWMG<u>RIDPYDSETHYNQKFKD</u>RFVFSVDKSVSTAYLQISSLKAEDTA VYYCAR<u>GNWDDY</u>WGQGTTVTVSS | 201 |
| CD123 | hzCAR-15 | MALPVTALLLPLALLLHAARPDVVMTQSPAFLSVTPGEKVTITC<u>RASKSISKDLA</u>WYQQK PDQAPKLLIY<u>SGSTLQS</u>GVPSRFSGSGSGTDFTFTISSLEAEDAATYYC<u>QQHNKYPYT</u>FG GGTKVEIKGGGGSGGGGSGGGGSGGGGSQVQLVQSGSELKKPGASVKVSCKAS<u>GYTFTSY WMN</u>WVRQAPGQGLEWMG<u>RIDPYDSETHYNQKFKD</u>RFVFSVDKSVSTAYLQISSLKAEDTA VYYCAR<u>GNWDDY</u>WGQGTTVTVSS | 202 |
| CD123 | hzCAR-16 | MALPVTALLLPLALLLHAARPDVVMTQSPDSLAVSLGERATINC<u>RASKSISKDLA</u>WYQQK PGQPPKLLIY<u>SGSTLQS</u>GVPDRFSGSGSGTDFTLTISSLQAEDVAVYYC<u>QQHNKYPYT</u>FG GGTKVEIKGGGGSGGGGSGGGGSGGGGSQVQLVQSGSELKKPGASVKVSCKAS<u>GYTFTSY WMN</u>WVRQAPGQGLEWMG<u>RIDPYDSETHYNQKFKD</u>RFVFSVDKSVSTAYLQISSLKAEDTA VYYCAR<u>GNWDDY</u>WGQGTTVTVSS | 203 |
| CD123 | hzCAR-17 | MALPVTALLLPLALLLHAARPEVQLVQSGAEVKKPGESLRISCKGS<u>GYTFTSYWMN</u>WVRQ MPGKGLEWMG<u>RIDPYDSETHYNQKFKD</u>HVTISVDKSISTAYLQWSSLKASDTAMYYCAR<u>G NWDDY</u>WGQGTTVTVSSGGGGSGGGGSGGGGSGGGGSDVQLTQSPSFLSASVGDRVTITC<u>R ASKSISKDLA</u>WYQQKPGKAPKLLIY<u>SGSTLQS</u>GVPSRFSGSGSGTEFTLTISSLQPEDFA TYYC<u>QQHNKYPYT</u>FGGGTKVEIK | 204 |
| CD123 | hzCAR-18 | MALPVTALLLPLALLLHAARPEVQLVQSGAEVKKPGESLRISCKGS<u>GYTFTSYWMN</u>WVRQ MPGKGLEWMG<u>RIDPYDSETHYNQKFKD</u>HVTISVDKSISTAYLQWSSLKASDTAMYYCAR<u>G NWDDY</u>WGQGTTVTVSSGGGGSGGGGSGGGGSGGGGSEVVLTQSPATLSLSPGERATLSC<u>R ASKSISKDLA</u>WYQQKPGQAPRLLIY<u>SGSTLQS</u>GIPARFSGSGSGTDFTLTISSLEPEDFA VYYC<u>QQHNKYPYT</u>FGGGTKVEIK | 205 |
| CD123 | hzCAR-19 | MALPVTALLLPLALLLHAARPEVQLVQSGAEVKKPGESLRISCKGS<u>GYTFTSYWMN</u>WVRQ MPGKGLEWMG<u>RIDPYDSETHYNQKFKD</u>HVTISVDKSISTAYLQWSSLKASDTAMYYCAR<u>G NWDDY</u>WGQGTTVTVSSGGGGSGGGGSGGGGSGGGGSDVVMTQSPAFLSVTPGEKVTITC<u>R ASKSISKDLA</u>WYQQKPDQAPKLLIY<u>SGSTLQS</u>GVPSRFSGSGSGTDFTFTISSLEAEDAA TYYC<u>QQHNKYPYT</u>FGGGTKVEIK | 206 |
| CD123 | hzCAR-20 | MALPVTALLLPLALLLHAARPEVQLVQSGAEVKKPGESLRISCKGS<u>GYTFTSYWMN</u>WVRQ MPGKGLEWMG<u>RIDPYDSETHYNQKFKD</u>HVTISVDKSISTAYLQWSSLKASDTAMYYCAR<u>G NWDDY</u>WGQGTTVTVSSGGGGSGGGGSGGGGSGGGGSDVVMTQSPDSLAVSLGERATINC<u>R ASKSISKDLA</u>WYQQKPGQPPKLLIY<u>SGSTLQS</u>GVPDRFSGSGSGTDFTLTISSLQAEDVA VYYC<u>QQHNKYPYT</u>FGGGTKVEIK | 207 |
| CD123 | hzCAR-21 | MALPVTALLLPLALLLHAARPDVQLTQSPSFLSASVGDRVTITC<u>RASKSISKDLA</u>WYQQK PGKAPKLLIY<u>SGSTLQS</u>GVPSRFSGSGSGTEFTLTISSLQPEDFATYYC<u>QQHNKYPYT</u>FG GGTKVEIKGGGGSGGGGSGGGGSGGGGSEVQLVQSGAEVKKPGESLRISCKGS<u>GYTFTSY WMN</u>WVRQMPGKGLEWMG<u>RIDPYDSETHYNQKFKD</u>HVTISVDKSISTAYLQWSSLKASDTA MYYCAR<u>GNWDDY</u>WGQGTTVTVSS | 208 |
| CD123 | hzCAR-22 | MALPVTALLLPLALLLHAARPEVVLTQSPATLSLSPGERATLSC<u>RASKSISKDLA</u>WYQQK PGQAPRLLIY<u>SGSTLQS</u>GIPARFSGSGSGTDFTLTISSLEPEDFAVYYC<u>QQHNKYPYT</u>FG GGTKVEIKGGGGSGGGGSGGGGSGGGGSEVQLVQSGAEVKKPGESLRISCKGS<u>GYTFTSY WMN</u>WVRQMPGKGLEWMG<u>RIDPYDSETHYNQKFKD</u>HVTISVDKSISTAYLQWSSLKASDTA MYYCAR<u>GNWDDY</u>WGQGTTVTVSS | 209 |

TABLE 4-continued

Exemplary Antigen Binding Domains

| Target Antigen | Name | Amino Acid Sequence | SEQ ID NO: |
|---|---|---|---|
| CD123 | hzCAR-23 | MALPVTALLLPLALLLHAARPDVVMTQSPAFLSVTPGEKVTITC<u>RASKSISKDLA</u>WYQQK PDQAPKLLIY<u>SGSTLQS</u>GVPSRFSGSGSGTDFTFTISSLEAEDAATYYC<u>QQHNKYPYT</u>FG GGTKVEIKGGGGSGGGGSGGGGSGGGGSEVQLVQSGAEVKKPGESLRISCKGS<u>GYTFTSY WMN</u>WVRQMPGKGLEWMG<u>RIDPYDSETHYNQKFKD</u>HVTISVDKSISTAYLQWSSLKASDTA MYYCAR<u>GNWDDY</u>WGQGTTVTVSS | 210 |
| CD123 | hzCAR-24 | MALPVTALLLPLALLLHAARPDVVMTQSPDSLAVSLGERATINC<u>RASKSISKDLA</u>WYQQK PGQPPKLLIY<u>SGSTLQS</u>GVPDRFSGSGSGTDFTLTISSLQAEDVAVYYC<u>QQHNKYPYT</u>FG GGTKVEIKGGGGSGGGGSGGGGSGGGGSEVQLVQSGAEVKKPGESLRISCKGS<u>GYTFTSY WMN</u>WVRQMPGKGLEWMG<u>RIDPYDSETHYNQKFKD</u>HVTISVDKSISTAYLQWSSLKASDTA MYYCAR<u>GNWDDY</u>WGQGTTVTVSS | 211 |
| CD123 | hzCAR-25 | MALPVTALLLPLALLLHAARPEVQLVESGGGLVQPGGSLRLSCAAS<u>GYTFTSYWMN</u>WVRQ APGKGLVWVS<u>RIDPYDSETHYNQKFKD</u>RFTISVDKAKSTAYLQMNSLRAEDTAVYYCAR<u>G NWDDY</u>WGQGTTVTVSSGGGGSGGGGSGGGGSGGGGSDVQLTQSPSFLSASVGDRVTITC<u>R ASKSISKDLA</u>WYQQKPGKAPKLLIY<u>SGSTLQS</u>GVPSRFSGSGSGTEFTLTISSLQPEDFA TYYC<u>QQHNKYPYT</u>FGGGTKVEIK | 212 |
| CD123 | hzCAR-26 | MALPVTALLLPLALLLHAARPEVQLVESGGGLVQPGGSLRLSCAAS<u>GYTFTSYWMN</u>WVRQ APGKGLVWVS<u>RIDPYDSETHYNQKFKD</u>RFTISVDKAKSTAYLQMNSLRAEDTAVYYCAR<u>G NWDDY</u>WGQGTTVTVSSGGGGSGGGGSGGGGSGGGGSEVVLTQSPATLSLSPGERATLSC<u>R ASKSISKDLA</u>WYQQKPGQAPRLLIY<u>SGSTLQS</u>GIPARFSGSGSGTDFTLTISSLEPEDFA VYYC<u>QQHNKYPYT</u>FGGGTKVEIK | 213 |
| CD123 | hzCAR-27 | MALPVTALLLPLALLLHAARPEVQLVESGGGLVQPGGSLRLSCAAS<u>GYTFTSYWMN</u>WVRQ APGKGLVWVS<u>RIDPYDSETHYNQKFKD</u>RFTISVDKAKSTAYLQMNSLRAEDTAVYYCAR<u>G NWDDY</u>WGQGTTVTVSSGGGGSGGGGSGGGGSGGGGSDVVMTQSPAFLSVTPGEKVTITC<u>R ASKSISKDLA</u>WYQQKPDQAPKLLIY<u>SGSTLQS</u>GVPSRFSGSGSGTDFTFTISSLEAEDAA TYYC<u>QQHNKYPYT</u>FGGGTKVEIK | 214 |
| CD123 | hzCAR-28 | MALPVTALLLPLALLLHAARPEVQLVESGGGLVQPGGSLRLSCAAS<u>GYTFTSYWMN</u>WVRQ APGKGLVWVS<u>RIDPYDSETHYNQKFKD</u>RFTISVDKAKSTAYLQMNSLRAEDTAVYYCAR<u>G NWDDY</u>WGQGTTVTVSSGGGGSGGGGSGGGGSGGGGSDVVMTQSPDSLAVSLGERATINC<u>R ASKSISKDLA</u>WYQQKPGQPPKLLIY<u>SGSTLQS</u>GVPDRFSGSGSGTDFTLTISSLQAEDVA VYYC<u>QQHNKYPYT</u>FGGGTKVEIK | 215 |
| CD123 | hzCAR-29 | MALPVTALLLPLALLLHAARPDVQLTQSPSFLSASVGDRVTITC<u>RASKSISKDLA</u>WYQQK PGKAPKLLIY<u>SGSTLQS</u>GVPSRFSGSGSGTEFTLTISSLQPEDFATYYC<u>QQHNKYPYT</u>FG GGTKVEIKGGGGSGGGGSGGGGSGGGGSEVQLVESGGGLVQPGGSLRLSCAAS<u>GYTFTSY WMN</u>WVRQAPGKGLVWVS<u>RIDPYDSETHYNQKFKD</u>RFTISVDKAKSTAYLQMNSLRAEDTA VYYCAR<u>GNWDDY</u>WGQGTTVTVSS | 216 |
| CD123 | hzCAR-30 | MALPVTALLLPLALLLHAARPEVVLTQSPATLSLSPGERATLSC<u>RASKSISKDLA</u>WYQQK PGQAPRLLIY<u>SGSTLQS</u>GIPARFSGSGSGTDFTLTISSLEPEDFAVYYC<u>QQHNKYPYT</u>FG GGTKVEIKGGGGSGGGGSGGGGSGGGGSEVQLVESGGGLVQPGGSLRLSCAAS<u>GYTFTSY WMN</u>WVRQAPGKGLVWVS<u>RIDPYDSETHYNQKFKD</u>RFTISVDKAKSTAYLQMNSLRAEDTA VYYCAR<u>GNWDDY</u>WGQGTTVTVSS | 217 |
| CD123 | hzCAR-31 | MALPVTALLLPLALLLHAARPDVVMTQSPAFLSVTPGEKVTITC<u>RASKSISKDLA</u>WYQQK PDQAPKLLIY<u>SGSTLQS</u>GVPSRFSGSGSGTDFTFTISSLEAEDAATYYC<u>QQHNKYPYT</u>FG GGTKVEIKGGGGSGGGGSGGGGSGGGGSEVQLVESGGGLVQPGGSLRLSCAAS<u>GYTFTSY WMN</u>WVRQAPGKGLVWVS<u>RIDPYDSETHYNQKFKD</u>RFTISVDKAKSTAYLQMNSLRAEDTA VYYCAR<u>GNWDDY</u>WGQGTTVTVSS | 218 |
| CD123 | hzCAR32 | MALPVTALLLPLALLLHAARPDVVMTQSPDSLAVSLGERATINC<u>RASKSISKDLA</u>WYQQK PGQPPKLLIY<u>SGSTLQS</u>GVPDRFSGSGSGTDFTLTISSLQAEDVAVYYC<u>QQHNKYPYT</u>FG GGTKVEIKGGGGSGGGGSGGGGSGGGGSEVQLVESGGGLVQPGGSLRLSCAAS<u>GYTFTSY WMN</u>WVRQAPGKGLVWVS<u>RIDPYDSETHYNQKFKD</u>RFTISVDKAKSTAYLQMNSLRAEDTA VYYCAR<u>GNWDDY</u>WGQGTTVTVSS | 219 |
| EGFR vIII | huscFv1 | Eiqlvqsgaevkkpgatvkisckgsgfniedyyihwvqqapgkglewmgridpendetkygpifqgrvtitad tstntvymelsslrsedtavyycafrggvywgqgttvtvssggggsggggsggggsggggsdvvmtqspdsla vslgeratinckssqslldsdgktylnwlqqkpgqppkrlislvskldsgvpdrfsgsgsgtdftltisslqaedv avyycwqgthfpgtfgggtkveik | 220 |
| EGFR vIII | huscFv2 | Dvvmtqspdslavslgeratinckssqslldsdgktylnwlqqkpgqppkrlislvskldsgvpdrfsgsgsgtdf tltisslqaedvavyycwqgthfpgtfgggtkveikggggsggggsggggsggggseiqlvqsgaevkkpgatv kisckgsgfniedyyihwvqqapgkglewmgridpendetkygpifqgrvtitadtstntvymelsslrsedtav yycafrggvywgqgttvtvss | 221 |

TABLE 4-continued

Exemplary Antigen Binding Domains

| Target Antigen | Name | Amino Acid Sequence | SEQ ID NO: |
|---|---|---|---|
| EGFR vIII | huscFv3 | Eiqlvqsgaevkkpgeslrisckgsgfniedyyihwvrqmpgkglewmgridpendetkygpifqghvtisad tsintvylqwsslkasdtamyycafrggvywgqttvtvssggggsggggsggggsggggsdvvmtqsplslp vtlgqpasisckssqslldsdgktylnwlqqrpgqsprrlislvskldsgvpdrfsgsgsgtdftlkisrveaed vgvyycwqgthfpgtfgggtkveik | 222 |
| EGFR vIII | huscFv4 | Dvvmtqsplslpvtlgqpasisckssqslldsdgktylnwlqqrpgqsprrlislvskldsgvpdrfsgsgsgtd ftlkisrveaedvgvyycwqgthfpgtfgggtkveikggggsggggsggggsggggseiqlvqsgaevkkpgeslr iscksgsgfniedyyihwvrqmpgkglewmgridpendetkygpifqghvtisadtsintvylqwsslkasdta myycafrggvywgqgttvtvss | 223 |
| EGFR vIII | huscFv5 | Eiqlvqsgaevkkpgatvkiscksgsgfniedyyihwvrqqapgkglewmgridpendetkygpifqgrvtitad tstntvymelsslrsedtavyycafrggvywgqttvtvssggggsggggsggggsggggsdvvmtqsplslpv tlgqpasisckssqslldsdgktylnwlqqrpgqsprrlislvskldsgvpdrfsgsgsgtdftlkisrveaedv gvyycwqgthfpgtfgggtkveik | 224 |
| EGFR vIII | huscFv6 | Eiqlvqsgaevkkpgeslriscksgsgfniedyyihwvrqmpgkglewmgridpendetkygpifqghvtisad tsintvylqwsslkasdtamyycafrggvywgqttvtvssggggsggggsggggsggggsdvvmtqspdsla vslgeratinckssqslldsdgktylnwlqqkpgqppkrlislvskldsgvpdrfsgsgsgtdftltisslqaedva vyycwqgthfpgtfgggtkveik | 225 |
| EGFR vIII | huscFv7 | Dvvmtqspdslavslgeratinckssqslldsdgktylnwlqqkpgqppkrlislvskldsgvpdrfsgsgsgtdf tltisslqaedvavyycwqgthfpgtfgggtkveikggggsggggsggggsggggseiqlvqsgaevkkpgesl riscksgsgfniedyyihwvrqmpgkglewmgridpendetkygpifqghvtisadtsintvylqwsslkasdta myycafrggvywgqgttvtvss | 226 |
| EGFR vIII | huscFv8 | Dvvmtqsplslpvtlgqpasisckssqslldsdgktylnwlqqrpgqsprrlislvskldsgvpdrfsgsgsgtdft lkisrveaedvgvyycwqgthfpgtfgggtkveikggggsggggsggggsggggseiqlvqsgaevkkpgatv kiscksgsgfniedyyihwvrqqapgkglewmgridpendetkygpifqgrvtitadtstntvymelsslrsedtav yycafrggvywgqgttvtvss | 227 |
| EGFR vIII | Mu310C | eiqlqqsgaelvkpgasvklsctgsgfniedyyihwvkqrteqglewigridpendetkygpifqgratitadtssn tvylqlssltsedtavyycafrggvywgpgttltvssggggsggggsggggshmdvvmtqspltlsvaigqsasis ckssqslldsdgktylnwllqrpgqspkrlislvskldsgvpdrftgsgsgtdftlrisrveaedlgiyycwqgthf pgtfgggtkleik | 228 |
| mesothelin | ss1 (mu) | Q V Q L Q Q S G P E L E K P G A S V K I S C K A S G Y S<br>F T G Y T M N W V K Q S H G K S L E W I G L I T P Y N G<br>A S S Y N Q K F R G K A T L T V D K S S S T A Y M D L L<br>S L T S E D S A V Y F C A R G G Y D G R G F D Y W G Q G<br>T T V T V S S G G G G S G G G G S G G G G S D I E L T Q<br>S P A I M S A S P G E K V T M T C S A S S S V S Y M H W<br>Y Q Q K S G T S P K R W I Y D T S K L A S G V P G R F S<br>G S G S G N S Y S L T I S S V E A E D D A T Y Y C Q Q W<br>S G Y P L T F G A G T K L E I | 229 |
| mesothelin M5 (human) | | QVQLVQSGAEVEKPGASVKVSCKAS<u>GYTFTDYYMH</u>WVRQAPGQGLEWMG<u>WINPNS GGTNYAQKFQ</u>GRVTMTRDTSISTAYMELSRLRSDDTAVYYCAS<u>GWDFDY</u>WGQGTL VTVSSGGGGSGGGGSGGGGSGGGGSDIVMTQSPSSLSASVGDRVTITC<u>R ASQSIRYYLS</u>WYQQKPGKAPKLLIY<u>TASILQN</u>GVPSRFSGSGSGTDFTLTISSLQ PEDFATYYC<u>LQTYTTTPDFGPGTKVEIK</u> | 234 |
| mesothelin M11 (human) | | QVQLQQSGAEVKKPGASVKVSCKAS<u>GYTFTGYYMH</u>WVRQAPGQGLEWMG<u>WINPNS GGTNYAQNFQ</u>GRVTMTRDTSISTAYMELRRLRSDDTAVYYCAS<u>GWDFDY</u>WGQGTL VTVSSGGGGSGGGGSGGGGSGGGGSDIRMTQSPSSLSASVGDRVTITC<u>RASQSIR YYLS</u>WYQQKPGKAPKLLIY<u>TASILQN</u>GVPSRFSGSGSGTDFTLTISSLQPEDFAT YYC<u>LQTYTTTPDFGPGTKVEIK</u> | 240 |
| mesothelin M1 (human) | | QVQLQQSGAEVKKPGASVKVSCKAS<u>GYTFTGYYMH</u>WVRQAPGQGLEW MGR<u>INPNSGGTNYAQKFQ</u>GRVTMTRDTSISTAYMELSRLRSEDTAVYYC AR<u>GRYYGMDV</u>WGQGTMVTVSSGGGGSGGGGSGGGGSGGGGSEIVLTQS PATLSLSPGERATISC<u>RASQSVSSNFAW</u>YQQRPGQAPRLLIY<u>DASNRATGIP PRFSGSGSGTDFTLTISSLEPEDFAAYYC<u>HQRSNWLYT</u>FGQGTKVDIK | 230 |
| mesothelin M2 (human) | | QVQLVQSGAEVKKPGASVKVSCKAS<u>GYTFTGYYMH</u>WVRQAPGQGLEWMG<u>WINPNS GGTNYAQKFQ</u>GRVTMTRDTSISTAYMELSRLRSDDTAVYYCARD<u>LRRTVVTPRAY YGMDV</u>WGQGTTVTVSSGGGGSGGGGSGGGGSGGGGSDIQLTQSPSTLSASVGDRV TITC<u>QASQDISNSLN</u>WYQQKAGKAPKLLIY<u>DASTLETG</u>VPSRFSGSGSGTDFSFT ISSLQPEDIATYYC<u>QQHDNLPLT</u>FGQGTKVEIK | 231 |
| mesothelin M3 (human) | | QVQLVQSGAEVKKPGAPVKVSCKAS<u>GYTFTGYYMH</u>WVRQAPGQGLEWMG<u>WINPNS GGTNYAQKFQ</u>GRVTMTRDTSISTAYMELSRLRSDDTAVYYCAR<u>GEWDGSYYYDY</u>W GQGTLVTVSSGGGGSGGGGSGGGGSGGGGSDIVLTQTPSSLSASVGDRVTITC<u>RA</u> | 232 |

TABLE 4-continued

Exemplary Antigen Binding Domains

| Target Antigen | Name | Amino Acid Sequence | SEQ ID NO: |
|---|---|---|---|
| | | SQSINTYLNWYQHKPGKAPKLLIYAASSLQSGVPSRFSGSGSGTDFTLTISSLQP EDFATYYCQQSFSPLTFGGGTKLEIK | |
| mesothelin | M4 (human) | QVQLVESGGGLVQPGGSLRLSCAASGFTFSSYWMHWVRQVPGKGLVWVSRINTDG STTTYADSVEGRFTISRDNAKNTLYLQMNSLRDDDTAVYYCVGGHWAVWGQGTTV TVSSGGGGSGGGGSGGGGSGGGGSDIQMTQSPSTLSASVGDRVTITCRASQSISD RLAWYQQKPGKAPKLLIYKASSLESGVPSRFSGSGSGTEFTLTISSLQPDDFAVY YCQQYGHLPMYTFGQGTKVEIK | 233 |
| mesothelin | M6 (human) | QVQLVQSGAEVKKPGASVKVSCKASGYTFTSYYMHWVRQAPGQGLEWMGIINPSG GSTSYAQKFQGRVTMTRDTSTSTVYMELSSLRSEDTAVYYCARYRLIAVAGDYYY YGMDVWGQGTMVTVSSGGGGSGGGGSGGGGSGGGGSDIQMTQSPSSVSASVGDRV TITCRASQGVGRWLAWYQQKPGTAPKLLIYAASTLQSGVPSRFSGSGSGTDFTLT INNLQPEDFATYYCQQANSFPLTFGGGTRLEIK | 235 |
| mesothelin | M7 (human) | QVQLVQSGGGVVQPGRSLRLSCAASGFTFSSYAMHWVRQAPGKGLEWVAVISYDG SNKYYADSVKGRFTISRDNSKNTLYLQMNSLRAEDTAVYYCARWKVSSSSPAFDY WGQGTLVTVSSGGGGSGGGGSGGGGSGGGGSEIVLTQSPATLSLSPGERAILSCR ASQSVYTKYLGWYQQKPGQAPRLLIYDASTRATGIPDRFSGSGSGTDFTLTINRL EPEDFAVYYCQHYGGSPLITFGQGTRLEIK | 236 |
| mesothelin | M8 (human) | QVQLQQSGAEVKKPGASVKVSCKTSGYPFTGYSLHWVRQAPGQGLEWMGWINPNS GGTNYAQKFQGRVTMTRDTSISTAYMELSRLRSDDTAVYYCQGTLVTVSSGGGGSGGGGSGGGGSGGGGSDIQLTQSPSSISASVGDTVSITCRAS QDSGTWLAWYQQKPGKAPNLLMYDASTLEDGVPSRFSGSASGTEFTLTVNRLQPE DSATYYCQQYNSYPLTFGGGTKVDIK | 237 |
| mesothelin | M9 (human) | QVQLVQSGAEVKKPGASVEVSCKASGYTFTSYYMHWVRQAPGQGLEWMGIINPSG GSTGYAQKFQGRVTMTRDTSTSTVHMELSSLRSEDTAVYYCARGGYSSSSDAFDI WGQGTMVTVSSGGGGSGGGGSGGGGSGGGGSDIQMTQSPPSLSASVGDRVTITCR ASQDISSALAWYQQKPGTPPKLLIYDASSLESGVPSRFSGSGSGTDFTLTISSLQ PEDFATYYCQQFSSYPLTFGGGTRLEIK | 238 |
| mesothelin | M10 (human) | QVQLVQSGAEVKKPGASVKVSCKASGYTFTSYGISWVRQAPGQGLEWMGWISAYN GNTNYAQKLQGRVTMTTDTSTSTAYMELRSLRSDDTAVYYCARVAGGIYYYYGMD VWGQGTTITVSSGGGGSGGGGSGGGGSGGGGSDIVMTQTPDSLAVSLGERATISC KSSHSVLYNRNNKNYLAWYQQKPGQPPKLLFYWASTRKSGVPDRFSGSGSGTDFT LTISSLQPEDFATYFCQQTQTFPLTFGQGTRLEIN | 239 |
| mesothelin | M12 (human) | QVQLVQSGAEVKKPGASVKVSCKASGYTFTGYYMHWVRQAPGQGLEWMGRINPNS GGTNYAQKFQGRVTMTTDTSTSTAYMELRSLRSDDTAVYYCARTTTSYAFDIWGQ GTMVTVSSGGGGSGGGGSGGGGSGGGGSDIQLTQSPSTLSASVGDRVTITCRASQ SISTWLAWYQQKPGKAPNLLIYKASTLESGVPSRFSGSGSGTEFTLTISSLQPDD FATYYCQQYNTYSPYTFGQGTKLEIK | 241 |
| mesothelin | M13 (human) | QVQLVQSGGGLVKPGGSLRLSCEASGFIFSDYYMGWIRQAPGKGLEWVSYIGRSG SSMYYADSVKGRFTFSRDNAKNSLYLQMNSLRAEDTAVYYCAASPVVAATEDFQH WGQGTLVTVSSGGGGSGGGGSGGGGSGGGGSDIVMTQTPATLSLSPGERATLSCR ASQSVTSNYLAWYQQKPGQAPRLLLFGASTRATGIPDRFSGSGSGTDFTLTINRL EPEDFAMYYCQQYGSAPVTFGQGTKLEIK | 242 |
| mesothelin | M14 (human) | QVQLVQSGAEVRAPGASVKISCKASGFTFRGYYIHWVRQAPGQGLEWMGIINPSG GSRAYAQKFQGRVTMTRDTSTSTVYMELSSLRSDDTAMYYCARTASCGGDCYYLD YWGQGTLVTVSSGGGGSGGGGSGGGGSGGGGSDIQMTQSPPTLSASVGDRVTITC RASENVNIWLAWYQQKPGKAPKLLIYKSSSLASGVPSRFSGSGSGAEFTLTISSL QPDDFATYYCQQYQSYPLTFGGGTKVDIK | 243 |
| mesothelin | M15 (human) | QVQLVQSGGGLVQPGRSLRLSCAASGFTFDDYAMHWVRQAPGKGLEWVSGISWNS GSIGYADSVKGRFTISRDNAKNSLYLQMNSLRAEDTAVYYCAKDGSSSWSWGYFD YWGQGTLVTVSSGGGGSGGGGSGGGGSSSELTQDPAVSVALGQTVRTTCQGDALR SYYASWYQQKPGQAPMLVIYGKNNRPSGIPDRFSGSDSGDTASLTITGAQAEDEA DYYCNSRDSSGYPVFGTGTKVTVL | 244 |
| mesothelin | M16 (human) | EVQLVESGGGLVQPGRSLRLSCAASGFTFDDYAMHWVRQAPGKGLEWVSGISWNS GSTGYADSVKGRFTISRDNAKNSLYLQMNSLRAEDTALYYCAKDSSSWYGGGSAF DIWGQGTMVTVSSGGGGSGGGGSGGGGSSSELTQEPAVSVALGQTVRITCQGDSL RSYYASWYQQKPGQAPVLVIFGRSRRPSGIPDRFSGSSSGNTASLIITGAQAEDE ADYYCNSRDNTANHYVFGTGTKLTVL | 245 |
| mesothelin | M17 (human) | EVQLVESGGGLVQPGRSLRLSCAASGFTFDDYAMHWVRQAPGKGLEWVSGISWNS GSTGYADSVKGRFTISRDNAKNSLYLQMNSLRAEDTALYYCAKDSSSWYGGGSAF DIWGQGTMVTVSSGGGGSGGGGSGGGGSSSELTQDPAVSVALGQTVRITCQGDSL RSYYASWYQQKPGQAPVLVIYGKNNRPSGIPDRFSGSSSGNTASLTITGAQAEDE ADYYCNSRGSSGNHYVFGTGTKVTVL | 246 |

TABLE 4-continued

Exemplary Antigen Binding Domains

| Target Antigen | Name | Amino Acid Sequence | SEQ ID NO: |
|---|---|---|---|
| mesothelin | M18 (human) | QVQLVQSGGGLVQPGGSLRLSCAASGFTFSSYWMHWVRQAPGKGLVWVSRINSDG SSTSYADSVKGRFTISRDNAKNTLYLQMNSLRAEDTAVYYCVRTGWVGSYYYYMD VWGKGTTVTVSSGGGGSGGGGSGGGGSGGGGSEIVLTQSPGTLSLSPGERATLSC RASQSVSSNYLAWYQQKPGQPPRLLIYDVSTRATGIPARFSGGGSGTDFTLTISS LEPEDFAVYYCQQRSNWPPWTFGQGTKVEIK | 247 |
| mesothelin | M19 (human) | QVQLVQSGGGVVQPGRSLRLSCAASGFTFSSYGMHWVRQAPGKGLEWVAVISYDG SNKYYADSVKGRFTISRDNSKNTLYLQMNSLRAEDTAVYYCAKGYSRYYYYGMDV WGQGTTVTVSSGGGGSGGGGSGGGGSGGGGSEIVMTQSPATLSLSPGERAILSCR ASQSVYTKYLGWYQQKPGQAPRLLIYDASTRATGIPDRFSGSGSGTDFTLTINRL EPEDFAVYYCQHYGGSPLITFGQGTKVDIK | 248 |
| mesothelin | M20 (human) | QVQLVQSGGGLVQPGGSLRLSCAASGFTFSSYAMSWVRQAPGKGLEWVSAISGSG GSTYYADSVKGRFTISRDNSKNTLYLQMNSLRAEDTAVYYCAKREAAAGHDWYFD LWGRGTLVTVSSGGGGSGGGGSGGGGSGGGGSDIRVTQSPSSLSASVGDRVTITC RASQSISSYLNWYQQKPGKAPKLLIYAASSLQSGVPSRFSGSGSGTDFTLTISSL QPEDFATYYCQQSYSIPLTFGQGTKVEIK | 249 |
| mesothelin | M21 (human) | QVQLVQSWAEVKKPGASVKVSCKASGYTFTSYYMHWVRQAPGQGLEWMGIINPSG GSTSYAQKFQGRVTMTRDTSTSTVYMELSNLRSEDTAVYYCARSPRVTTGYFDYW GQGTLVTVSSGGGGSGGGGSGGGGSGGGGSDIQLTQSPSTLSASVGDRVTITCRA SQSISSWLAWYQQKPGKAPKLLIYKASSLESGVPSRFSGSGSGTEFTLTISSLQP DDFATYYCQQYSSYPLTFGGGTRLEIK | 250 |
| mesothelin | M22 (human) | QVQLVQSGAEVRRPGASVKISCRASGDTSTRHYIHWLRQAPGQGPEWMGVINPTT GPATGSPAYAQMLQGRVTMTRDTSTRTVYMELRSLRFEDTAVYYCARSVVGRSAP YYFDYWGQGTLVTVSSGGGGSGGGGSGGGGSGGGGSDIQMTQSPSSLSASVGDRV TITCRASQGISDYSAWYQQKPGKAPKLLIYAASTLQSGVPSRFSGSGSGTDFTLT ISYLQSEDFATYYCQQYYSYPLTFGGGTKVDIK | 251 |
| mesothelin | M23 (human) | QVQLQQSGAEVKKPGASVKVSCKASGYTFTNYYMHWVRQAPGQGLEWMGIINPSG GYTTYAQKFQGRLTMTRDTSTSTVYMELSSLRSEDTAVYYCARIRSCGGDCYYFD NWGQGTLVTVSSGGGGSGGGGSGGGGSGGGGSDIQLTQSPSTLSASVGDRVTITC RASENVNIWLAWYQQKPGKAPKLLIYKSSSLASGVPSRFSGSGSGAEFTLTISSL QPDDFATYYCQQYQSYPLTFGGGTKVDIK | 252 |
| mesothelin | M24 (human) | QITLKESGPALVKPTQTLTLTCTFSGFSLSTAGVHVGWIRQPPGKALEWLALISW ADDKRYRPSLRSRLDITRVTSKDQVVLSMTNMQPEDTATYYCALQGFDGYEANWG PGTLVTVSSGGGGSGGGGSGGGGSGGGGSDIVMTQSPSSLSASAGDRVTITCRAS RGISSALAWYQQKPGKPPKLLIYDASSLESGVPSRFSGSGSGTDFTLTIDSLEPE DFATYYCQQSYSTPWTFGQGTKVDIK | 253 |
| CLL-1 | 139115 (human) | EVQLQQSGAEVKKPGSSVKVSCKASGGTFSSYAISWVRQAPGQGLEWMGGIIPIFGTANYA QKFQGRVTITADESTSTAYMELSSLRSEDTAVYYCARDLEMATIMGGYWGQGTLVTVSSGG GGSGGGGSGGGGSQSALTQPASVSGSPGQSITISCTGTSSDVGGYNYVSWYQQHPGKAPKL MIYDVSNRPSGVSNRFSGSKSGNTASLTISGLQAEDEADYYCSSYTSSSTLDVVFGGGTKL TVL | 254 |
| CLL-1 | 139116 (human) | EVQLVESGGGVVQPGGSLRLSCAASGFTFDDYAMHWVRQAPGKGLEWVSLISGDGGSTYYA DSVKGRFTISRDNSKNTLYLQMNSLRVEDTAVYYCARVFDSYYMDVWGKGTTVTVSSGGGG SGGGGSGSGGSEIVLTQSPLSLPVTPGQPASICRSSQSLVYTDGNTYLNWFQQRPGQSPR RLIYKVSNRDSGVPDRFSGSGSDTDFTLKISRVEAEDVGIYYCMQGTHWSFTFGQGTRLEI K | 255 |
| CLL-1 | 139118 (human) | QVQLQESGPGLVKPSETLSLTCTVSGGSISSSSYYWGWIRQPPGKGLEWIGSIYYSGSTYY NPSLKSRVSISVDTSKNQFSLKLKYVTAADTAVYYCATPGTYYDFLSGYYPFYWGQGTLVT VSSGGGGSGGGGSGGGGSDIVMTQSPSSLSASVGDRVTITCRASQGISSYLAWYQQKPGKA PKLLIYAASTLQSGVPSRFSGSGSGTDFTLTISSLQPEDFATYYCQQLNSYPYTFGQGTKL EIK | 256 |
| CLL-1 | 139122 (human) | QVQLVESGGGLVQPGGSLRLSCAASGFTFSSYWMSWVRQAPGKGLEWVANINEDGSAKFYV DSVKGRFTISRDNAKNSLYLQMNSLRAEDTAVYFCARDLRSGRYWGQGTLVTVSSGGGGSG GGGSGGGGSEIVLTQSPGTLSLSPGGRATLSCRASQSISGSFLAWYQQKPGQAPRLLIYGA SSRATGIPDRFSGSGSGTDFTLTISRLEPEDFAVYYCQQYGSSPPTFGLGTKLEIK | 257 |
| CLL-1 | 139117 (human) | EVQLQQSGPGLVRPSETLSLTCTVSGGPVRSGSHYWNWIRQPPGRGLEWIGYIYYSGSTNY NPSLENRVTISIDTSNNHFSLKLSSVTAADTALYFCARGTATFDWNFPFDSWGQGTLVTVS SGGGGSGGGGSGSGGSDIQMTQSPSSLSASIGDRVTITCRASQSISSYLNWYQQKPGKAPK LLIYAASSLQSGVPSRFSGSGSGTDFTLTISSLQPEDFATYYCQQSYSTPWTFGQGTKLEI K | 258 |
| CLL-1 | 139119 (human) | QVQLQESGAGLLKPSETLSLTCAVYGGSFSGYYWSWIRQPPGKGLEWVGEINHSGSTNYNP SLKSRVTISVDTSKNQFSLKLSSVTAADTAVYYCARGSGLVVYAIRVGSGWFDYWGQGTLV | 259 |

TABLE 4-continued

Exemplary Antigen Binding Domains

| Target Antigen | Name | Amino Acid Sequence | SEQ ID NO: |
|---|---|---|---|
| | | TVSSGGGGSGGGDSGGGGSDIQMTQSPSSLSASVGDRVTITC<u>RASQSISSYLN</u>WYQQKPGK APKLLMY<u>AASSLQS</u>GVPSRFSGSGSGTDFTLTISSLQPEDFATYYC<u>QQSYSTPPWT</u>FGQGT KVDIK | |
| CLL-1 | 139120 (human) | EVQLVESGGGLVKPGGSLRLSCAAS<u>GFTFSSYSMN</u>WVRQAPGKGLEWVS<u>SISSSSSYIYYA DSVKG</u>RFTISRDNAKNSLYLQMNSLRAEDTAVYYCARD<u>PSSSGSYYMEDSYYYGMDV</u>WGQG TTVTVSSGGGGSGGGGSGGGGSNFMLTQPHSVSESPGKTVTISC<u>TGSSGSIASNYVQ</u>WYQQ RPGSAPTTVIY<u>EDNQRPS</u>GVPDRFSGSIDSSSNSASLTISGLKTEDEADYYC<u>QSYDSSNQV V</u>FGGGTKLTVL | 260 |
| CLL-1 | 139121 (human) | QVNLRESGGGLVQPGGSLRLSCAAS<u>GFTFSSYEMN</u>WVRQAPGKGLEWVS<u>YISSSGSTIYYA DSVKG</u>RFTISRDNAKNSLYLQMNSLRAEDTAVYYCARE<u>ALGSSWE</u>WGQGTTVTVSSGGGGS GGGGSGGGGSDIQMTQSPSSLSASVGDRVTITC<u>QASQDISNYLN</u>WYQQKPGKAPKLLIYD<u>A SNLET</u>GVPSRFSGSGSGTDFTFTISSLQPEDIATYYC<u>QQYDNLPLT</u>FGGGTKLEIK | 261 |
| CLL-1 | 146259 (human) | QVQLVQSGAEVKKPGASVKVSCKAP<u>ANTFSDHVMH</u>WVRQAPGQRFEWMG<u>YIHAANGGTHYS QKFQD</u>RVTITRDTSANTVYMDLSSLRSEDTAVYYCARG<u>GYNSDAFDI</u>WGQGTMVTVSSGGG GSGGGGSGGGGSGGGGSDIVMTQSPSSVSASVGDRVTITC<u>RASQDISSWLA</u>WYQQKPGKAP KLLIY<u>AASSLQS</u>GVPSRFNGSGSGTDFTLTISSLQPEDFATYYC<u>QQSYSTPLT</u>FGGGTKVE IK | 262 |
| CLL-1 | 146261 (human) | QVQLVQSGGGLVQPGGSLRLSCAAS<u>GFTFSSYSMN</u>WVRQAPGKGLEWVS<u>YISSSSSTIYYA DSVKG</u>RFTISRDNAKNSLYLQMNSLRAEDTAVYYCARD<u>LSVRAIDAFDI</u>WGQGTMVTVSSG GGGSGGGGSGGGGSGGGGSDIVLTQSPSSLSASVGDRVTITC<u>QASQDISNYLN</u>WYQQKPGK APKLLIY<u>DASNLET</u>GVPSRFSGSGSGTDFTFTISSLQPEDFATYYC<u>QQAYSTPFT</u>FGPGTK VEIK | 263 |
| CLL-1 | 146262 (human) | EVQLVQSGGGVVRSGRSLRLSCAAS<u>GFTFNSYGLH</u>WVRQAPGKGLEWVA<u>LIEYDGSNKYYG DSVKG</u>RFTISRDKSKSTLYLQMDNLRAEDTAVYYCARE<u>GNEDLAFDI</u>WGQGTLVTVSSGGG GSGGGGSGGGGSGGGGSEIVLTQSPSSLSASVGDRVTITC<u>QASQFIKKNLN</u>WYQHKPGKAP KLLIY<u>DASSLQT</u>GVPSRFSGNRSGTTFSFTISSLQPEDVATYYC<u>QQHDNLPLT</u>FGGGTKVE IK | 264 |
| CLL-1 | 146263 (human) | QVQLVESGGGLVQPGGSLRLSCAAS<u>GFNVSSNYMT</u>WVRQAPGKGLEWVS<u>VIYSGGATYYGD SVKG</u>RFTVSRDNSKNTVYLQMNRLTAEDTAVYYCARD<u>RLYCGNNCYLYYYYGMDV</u>WGQGTL VTVSSGGGGSGGGGSGGGGSGGGGSDIQVTQSPSSLSASVGDRVTITC<u>RASQSISSYLN</u>WY QQKPGKAPKLLIY<u>AASSLQS</u>GVPSRFSGSGSGTDFTLTISSLQPEDFATYYC<u>QQSYSTPPL T</u>FGQGTKVEIK | 265 |
| CLL-1 | 146264 (human) | QVQLVQSGAEVKKSGASVKVSCKAS<u>GYPFTGYYIQ</u>WVRQAPGQGLEWMG<u>WIDPNSGNTGYA QKFQG</u>RVTMTRNTSISTAYMELSSLRSEDTAVYYCAS<u>DSYGYYYGMDV</u>WGQGTLVTVSSGG GGSGGGGSGGGGSGGGGSDIQMTQSPSSLSASVGDRVTFTC<u>RASQGISSALA</u>WYQQKPGKP PKLLIY<u>DASSLES</u>GVPSRFSGSGSGTDFTLTISSLQPEDFATYYC<u>QQFNNYPLT</u>FGGGTKV EIK | 266 |
| CLL-1 | 181268 (human) | EVQLVESGGGLVQPGGSLRLSCAAS<u>GFTFSSYEMN</u>WVRQAPGKGLEWVS<u>YISSSGSTIYYA DSVKG</u>RFTISRDNAKNSLYLQMNSLRAEDTAVYYCARD<u>PYSSSWHDAFDI</u>WGQGTMVTVSS GGGGSGGGGSGGGGSEIVLTQSPGTLSLSPGERATLS<u>RASQSVSSSYLA</u>WYQQKPGQAPR LLIY<u>GASSRAT</u>GIPDRFSGSGSGTDFTLTISRLEPEDFAVYYC<u>QQYGSSPLT</u>FGGGTKVDI K | 267 |
| BCMA | 139103 (human) | QVQLVESGGGLVQPGRSLRLSCAAS<u>GFTFSNYAMS</u>WVRQAPGKGLGWVS<u>GISRSGENTYYA DSVKG</u>RFTISRDNSKNTLYLQMNSLRDEDTAVYYCARS<u>PAHYYGMDV</u>WGQGTTVTVSSAS GGGGSGGRASGGGGSDIVLTQSPGTLSLSPGERATLSC<u>RASQSISSSFLA</u>WYQQKPGQAPR LLIY<u>GASRRAT</u>GIPDRFSGSGSGTDFTLTISRLEPEDSAVYYC<u>QQYHSSPSWT</u>FGQGTKLE IK | 268 |
| BCMA | 139105 (human) | QVQLVESGGGLVQPGRSLRLSCAAS<u>GFTFDDYAMH</u>WVRQAPGKGLEWVS<u>GISWNSGSIGYA DSVKG</u>RFTISRDNAKNSLYLQMNSLRAEDTALYYCSV<u>HSFLAY</u>WGQGTLVTVSSASGGGGS GGRASGGGGSDIVMTQTPLSLPVTPGEPASISC<u>RSSQSLLHSNGYNYLD</u>WYLQKPGQSPQL LIY<u>LGSNRAS</u>GVPDRFSGSGSGTDFTLKISRVEAEDVGVYYC<u>MQALQTPYT</u>FGQGTKVEIK | 269 |
| BCMA | 139111 (human) | EVQLLESGGGLVQPGGSLRLSCAVS<u>GFALSNHGMS</u>WVRRAPGKGLEWVS<u>GIVYSGSTYYAA SVKG</u>RFTISRDNSRNTLYLQMNSLRPEDTAIYYCSA<u>HGGESDV</u>WGQGTTVTVSSASGGGGS GGRASGGGGSDIVMTQTPLSLSVTPGQPASISC<u>KSSQSLLRNDGKTPLY</u>WYLQKAGQPPQL LIY<u>EVSNRFS</u>GVPDRFSGSGSGTDFTLKISRVEAEDVGAYYC<u>MQNIQFPS</u>FGGGTKLEIK | 270 |
| BCMA | 139100 (human) | QVQLVQSGAEVRKTGASVKVSCKAS<u>GYIFDNFGIN</u>WVRQAPGQGLEWMG<u>WINPKNNNTNYA QKFQG</u>RVTITADESTNTAYMEVSRSEDTAVYYCARG<u>PYYYQSYMDV</u>WGQGTMVTVSSAS GGGGSGGRASGGGGSDIVMTQTPLSLPVTPGEPASISC<u>RSSQSLLHSNGYNYLN</u>WYLQKPG QSPQLLIY<u>LGSKRAS</u>GVPDRFSGSGSGTDFTLHITRVGAEDVGVYYC<u>MQALQTPYT</u>FGQGT KLEIK | 271 |

TABLE 4-continued

Exemplary Antigen Binding Domains

| Target Antigen | Name | Amino Acid Sequence | SEQ ID NO: |
|---|---|---|---|
| BCMA | 139101 (human) | QVQLQESGGGLVQPGGSLRLSCAASGFTFSSDAMTWVRQAPGKGLEWVSVISGSGGTTYYA DSVKGRFTISRDNSKNTLYLQMNSLRAEDTAVYYCAKLDSSGYYYARGPRYWGQGTLVTVS SASGGGGSGGRASGGGGSDIQLTQSPSSLSASVGDRVTITCRASQSISSYLNWYQQKPGKA PKLLIYGASTLASGVPARFSGSGSGTHFTLTINSLQSEDSATYYCQQSYKRASFGQGTKVE IK | 272 |
| BCMA | 139102 (human) | QVQLVQSGAEVKKPGASVKVSCKASGYTFSNYGITWVRQAPGQGLEWMGWISAYNGNTNYA QKFQGRVTMTRNTSISTAYMELSSLRSEDTAVYYCARGPYYYYMDVWGKGTMVTVSSASGG GGSGGRASGGGGSEIVMTQSPLSLPVTPGEPASISCRSSQSLLYSNGYNYVDWYLQKPGQS PQLLIYLGSNRASGVPDRFSGSGSGTDFKLQISRVEAEDVGIYYCMQGRQFPYSFGQGTKV EIK | 273 |
| BCMA | 139104 (human) | EVQLLETGGGLVQPGGSLRLSCAVSGFALSNHGMSWVRRAPGKGLEWVSGIVYSGSTYYAA SVKGRFTISRDNSRNTLYLQMNSLRPEDTAIYYCSAHGGESDVWGQGTTVTVSSASGGGGS GGRASGGGGSEIVLTQSPATLSVSPGESATLSCRASQSVSSNLAWYQQKPGQAPRLLIYGA STRASGIPDRFSGSGSGTDFTLTISSLQAEDVAVYYCQQYGSSLTFGGGTKVEIK | 274 |
| BCMA | 139106 (human) | EVQLVETGGGLVQPGGSLRLSCAVSGFALSNHGMSWVRRAPGKGLEWVSGIVYSGSTYYAA SVKGRFTISRDNSRNTLYLQMNSLRPEDTAIYYCSAHGGESDVWGQGTTVTVSSASGGGGS GGRASGGGGSEIVMTQSPATLSVSPGERATLSCRASQSVSSKLAWYQQKPGQAPRLLMYGA SIRATGIPDRFSGSGSGTEFTLTISSLEPEDFAVYYCQQYGSSSWTFGQGTKVEIK | 275 |
| BCMA | 139107 (human) | EVQLVETGGGVVQPGGSLRLSCAVSGFALSNHGMSWVRRAPGKGLEWVSGIVYSGSTYYAA SVKGRFTISRDNSRNTLYLQMNSLRPEDTAIYYCSAHGGESDVWGQGTTVTVSSASGGGGS GGRASGGGGSEIVLTQSPGTLSLSPGERATLSCRASQSVGSTNLAWYQQKPGQAPRLLIYD ASNRATGIPDRFSGGGSGTDFTLTISRLEPEDFAVYYCQQYGSSPPWTFGQGTKVEIK | 276 |
| BCMA | 139108 (human) | QVQLVESGGGLVKPGGSLRLSCAASGFTFSDYYMSWIRQAPGKGLEWVSYISSSGSTIYYA DSVKGRFTISRDNAKNSLYLQMNSLRAEDTAVYYCARESGDGMDVWGQGTTVTVSSASGGG GSGGRASGGGGSDIQMTQSPSSLSASVGDRVTITCRASQSISSYLNWYQQKPGKAPKLLIY AASSLQSGVPSRFSGSGSGTDFTLTISSLQPEDFATYYCQQSYTLAFGQGTKVDIK | 277 |
| BCMA | 139109 (human) | EVQLVESGGGLVQPGGSLRLSCAVSGFALSNHGMSWVRRAPGKGLEWVSGIVYSGSTYYAA SVKGRFTISRDNSRNTLYLQMNSLRPEDTAIYYCSAHGGESDVWGQGTTVTVSSASGGGGS GGRASGGGGSDIQLTQSPSSLSASVGDRVTITCRASQSISSYLNWYQQKPGKAPKLLIYAA SSLQSGVPSRFSGSGSGTDFTLTISSLQPEDFATYYCQQSYSTPYTFGQGTKVEIK | 278 |
| BCMA | 139110 (human) | QVQLVQSGGGLVKPGGSLRLSCAASGFTFSDYYMSWIRQAPGKGLEWVSYISSSGNTIYYA DSVKGRFTISRDNAKNSLYLQMNSLRAEDTAVYYCARSTMVREDYWGQGTLVTVSSASGGG GSGGRASGGGGSDIVLTQSPLSLPVTLGQPASISCKSSESLVHNSGKTYLNWFHQRPGQSP RRLIYEVSNRDSGVPDRFTGSGSGTDFTLKISRVEAEDVGVYYCMQGTHWPGTFGQGTKLE IK | 279 |
| BCMA | 139112 (human) | QVQLVESGGGLVQPGGSLRLSCAVSGFALSNHGMSWVRRAPGKGLEWVSGIVYSGSTYYAA SVKGRFTISRDNSRNTLYLQMNSLRPEDTAIYYCSAHGGESDVWGQGTTVTVSSASGGGGS GGRASGGGGSDIRLTQSPSPLSASVGDRVTITCQASEDINKFLNWYHQTPGKAPKLLIYDA STLQTGVPSRFSGSGSGTDFTLTINSLQPEDIGTYYCQQYESLPLTFGGGTKVEIK | 280 |
| BCMA | 139113 (human) | EVQLVETGGGLVQPGGSLRLSCAVSGFALSNHGMSWVRRAPGKGLEWVSGIVYSGSTYYAA SVKGRFTISRDNSRNTLYLQMNSLRPEDTAIYYCSAHGGESDVWGQGTTVTVSSASGGGGS GGRASGGGGSETTLTQSPATLSVSPGERATLSCRASQSVGSNLAWYQQKPGQPRLLIYGA STRATGIPARFSGSGSGTEFTLTISSLQPEDFAVYYCQQYNDWLPVTFGQGTKVEIK | 281 |
| BCMA | 139114 (human) | EVQLVESGGGLVQPGGSLRLSCAVSGFALSNHGMSWVRRAPGKGLEWVSGIVYSGSTYYAA SVKGRFTISRDNSRNTLYLQMNSLRPEDTAIYYCSAHGGESDVWGQGTTVTVSSASGGGGS GGRASGGGGSEIVLTQSPGTLSLSPGERATLSCRASQSIGSSSLAWYQQKPGQAPRLLMYG ASSRASGIPDRFSGSGSGTDFTLTISRLEPEDFAVYYCQQYAGSPPFTFGQGTKVEIK | 282 |
| BCMA | 149362 (human) | QVQLQESGPGLVKPSETLSLTCTVSGGSISSSYYWGWIRQPPGKGLEWIGSIYYSGSAYY NPSLKSRVTISVDTSKNQFSLRLSSVTAADTAVYYCARHWQEWPDAFDIWGQGTMVTVSSG GGGSGGGGSGGGGSETTLTQSPAFMSATPGDKVIISCKASQDIDDAMNWYQQKPGEAPLFI IQSATSPVPGIPPRFSGSGFGTDFSLTINNIESEDAAYYFCLQHDNFPLTFGGGTKLEIK | 283 |
| BCMA | 149363 (human) | VNLRESGPALVKPTQTLTLTCTFSGFSLRTSGMCVSWIRQPPGKALEWLARIDWDEDKFYS TSLKTRLTISKDTSDNQVVLRMTNMDPADTATYYCARSGAGGTSATAFDIWGPGTMVTVSS GGGGSGGGGSGGGGSDIQMTQSPSSLSASVGDRVTITCRASQDIYNNLAWFQLKPGSAPRS LMYAANKSQSGVPSRFSGSASGTDFTLTISSLQPEDFATYYCQHYYRFPYSFGQGTKLEIK | 284 |
| BCMA | 149364 (human) | EVQLVESGGGLVKPGGSLRLSCAASGFTFSSYSMNWVRQAPGKGLEWVSSISSSSSYIYYA DSVKGRFTISRDNAKNSLYLQMNSLRAEDTAVYYCAKTIAAVYAFDIWGQGTTVTVSSGGG GSGGGGSGGGGSEIVLTQSPLSLPVTPEEPASISCRSSQSLLHSNGYNYLDWYLQKPGQSP QLLIYLGSNRASGVPDRFSGSGSGTDFTLKISRVEAEDVGVYYCMQALQTPYTFGQGTKLE IK | 285 |

TABLE 4-continued

Exemplary Antigen Binding Domains

| Target Antigen | Name | Amino Acid Sequence | SEQ ID NO: |
|---|---|---|---|
| BCMA | 149365 (human) | EVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDLRGAFDIWGQGTMVTVSSGGGGSGGGGSGGGGSSYVLTQSPSVSAAPGYTATISCGGNNIGTKSVHWYQQKPGQAPLLVIRDDSVRPSKIPGRFSGSNSGNMATLTISGVQAGDEADFYCQVWDSDSEHVVFGGGTKLTVL | 286 |
| BCMA | 149366 (human) | QVQLVQSGAEVKKPGASVKVSCKPSGYTVTSHYIHWVRRAPGQGLEWMGMINPSGGVTAYSQTLQGRVTMTDTSSSTVYMELSSLRSEDTAMYYCAREGSGSGWYFDFWGRGTLVTVSSGGGGSGGGGSGGGGSSYVLTQPPSVSVSPGQTASITCSGDGLSKKYVSWYQQKAGQSPVVLISRDKERPSGIPDRFSGSNSADTATLTISGTQAMDEADYYCQAWDDTTVVFGGGTKLTVL | 287 |
| BCMA | 149367 (human) | QVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCARAGIAARLRGAFDIWGQGTMVTVSSGGGGSGGGGSGGGGSDIVMTQSPSSVSASVGDRVIITCRASQGIRNWLAWYQQKPGKAPNLLIYAASNLQSGVPSRFSGSGSGADFTLTISSLQPEDVATYYCQKYNSAPFTFGPGTKVDIK | 288 |
| BCMA | 149368 (human) | QVQLVQSGAEVKKPGSSVKVSCKASGGTFSSYAISWVRQAPGQGLEWMGGIIPIFGTANYAQKFQGRVTITADESTSTAYMELSSLRSEDTAVYYCARRGGYQLLRWDVGLLRSAFDIWGQGTMVTVSSGGGGSGGGGSGGGGSSYVLTQPPSVSVAPGQTARITCGGNNIGSKSVHWYQQKPGQAPVLVLYGKNNRPSGVPDRFSGSRSGTTASLTITGAQAEDEADYYCSSRDSSGDHLRVFGTGTKVTVL | 289 |
| BCMA | 149369 (human) | EVQLQQSGPGLVKPSQTLSLTCAISGDSVSSNSAAWNWIRQSPSRGLEWLGRTYYRSKWYSFYAISLKSRIIINPDTSKNQFSLQLKSVTPEDTAVYYCARSSPEGLFLYWFDPWGQGTLVTVSSGGDGSGGGGSGGGGSSSELTQDPAVSALGQTIRITCQGDSLGNYYATWYQQKPGQAPVLVIYGTNNRPSGIPDRFSASSSGNTASLTITGAQAEDEADYYCNSRDSSGHHLLFGTGTKVTVL | 290 |
| BCMA | EBB-C1978-A4 (human) | EVQLVESGGGLVQPGGSLRLSCAASGFTFSSYAMSWVRQAPGKGLEWVSAISGSGGSTYYADSVKGRFTISRDNKNTLYLQMNSLRAEDTAVYYCAKVEGSGSLDYWGQGTLVTVSSGGGGSGGGGSGGGGSEIVMTQSPGTLSLSPGERATLSCRASQSVSSAYLAWYQQKPGQPPRLLISGASTRATGIPDRFGGSGSGTDFTLTISRLEPEDFAVYYCQHYGSSFNGSSLFTFGQGTRLEIK | 291 |
| BCMA | EBB-C1978-G1 (human) | EVQLVETGGGLVQPGGSLRLSCAASGITFSRYPMSWVRQAPGKGLEWVSGISDSGVSTYYADSAKGRFTISRDNSKNTLFLQMSSLRDEDTAVYYCVTRAGSEASDIWGQGTMVTVSSGGGGSGGGGSGGGGSEIVLTQSPATLSLSPGERATLSCRASQSVSNSLAWYQQKPGQAPRLLIYDASSRATGIPDRFSGSGSGTDFTLTISRLEPEDFAIYYCQQFGTSSGLTFGGGTKLEIK | 292 |
| BCMA | EBB-C1979-C1 (human) | QVQLVESGGGLVQPGGSLRLSCAASGFTFSSYAMSWVRQAPGKGLEWVSAISGSGGSTYYADSVKGRFTISRDNAKNSLYLQMNSLRAEDTAIYYCARATYKRELRYYYGMDVWGQGTMVTVSSGGGGSGGGGSGGGGSEIVMTQSPGTVSLSPGERATLSCRASQSVSSSFLAWYQQKPGQAPRLLIYGASSRATGIPDRFSGSGSGTDFTLTISRLEPEDSAVYYCQQYHSSPSWTFGQGTRLEIK | 293 |
| BCMA | EBB-1978-C7 (human) | EVQLVETGGGLVQPGGSLRLSCAASGFTFSSYAMSWVRQAPGKGLEWVSAISGSGGSTYYADSVKGRFTISRDNSKNTLYLQMNTLKAEDTAVYYCARATYKRELRYYYGMDVWGQGTTVTVSSGGGGSGGGGSGGGGSEIVMTQSPTLSLSPGESATLSCRASQSVSTTFLAWYQQKPGQAPRLLIYGSSNRATGIPDRFSGSGSGTDFTLTIRRLEPEDFAVYYCQQYHSSPSWTFGQGTKVEIK | 294 |
| BCMA | EBB-1978-D10 (human) | EVQLVETGGGLVQPGRSLRLSCAASGFTFDDYAMHWVRQAPGKGLEWVSGISWNSGSIGYADSVKGRFTISRDNAKNSLYLRDEDTAVYYCARVGKAVPDVWGQGTTVTVSSGGGGSGGGGSGGGGSDIVMTQTPSSLSASVGDRVTITCRASQSISSYLNWYQQKPGKAPKLLIYAASSLQSGVPSRFSGSGSGTDFTLTISSLQPEDFATYYCQQSYSTPYSFGQGTRLEIK | 295 |
| BCMA | EBB-1979-C12 (human) | EVQLVESGGGLVQPGRSLRLSCTASGFTFDDYAMHWVRQRPGKGLEWVASINWKGNSLAYGDSVKGRFAISRDNAKNTVFLQMNSLRTEDTAVYYCASHQVAYYNYAMDVWGRGTLVTVSSGGGGSGGGGSGGGGSEIVLTQSPGTLSLSPGERATLSCRATQSIGSSFLAWYQQRPGQAPRLLIYGASQRATGIPDRFSGRGSGTDFTLTISRVEPEDSAVYYCQHYESSPSWTFGQGTKVEIK | 296 |
| BCMA | EBB-1980-G4 (human) | EVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKVVRDGMDVWGQGTTVTVSSGGGGSGGGGSGGGGSEIVLTQSPATLSLSPGERATLSCRASQSVSSSYLAWYQQKPGQAPRLLIYGASSRATGIPDRFSGNGSGTDFTLTISRLEPEDFAVYYCQQYGSPPRFTFGPGTKVDIK | 297 |
| BCMA | EBB-1980-D2 (human) | EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKIPQTGTFDYWGQGTLVTVSSGGGGSGGGGSGGGGSEIVLTQSPGTLSLSPGERATLSCRASQSVSSSYLAWYQQRPGQAPRLLIYGASSRATGIPDRFSGSGSGTDFTLTISRLEPEDFAVYYCQHYGSSPSWTFGQGTRLEIK | 298 |

TABLE 4-continued

Exemplary Antigen Binding Domains

| Target Antigen | Name | Amino Acid Sequence | SEQ ID NO: |
|---|---|---|---|
| BCMA | EBB-1978-A10 (human) | EVQLVETGGGLVQPGGSLRLSCAASGFTFSSYAMSWVRQAPGKGLEWVSAISGSG GSTYYADSVKGRFTMSRENDKNSVFLQMNSLRVEDTGVYYCARANYKRELRYYY GMDVWGQGTMVTVSSGGGGSGGGGSGGGGSEIVMTQSPGTLSLSPGESATLSCR ASQRVASNYLAWYQHKPGQAPSLLISGASSRATGVPDRFSGSGSGTDFTLAISRLEP EDSAVYYCQHYDSSPSWTFGQGTKVEIK | 299 |
| BCMA | EBB-1978-D4 | EVQLLETGGGLVQPGGSLRLSCAASGFSFSSYAMSWVRQAPGKGLEWVSAISGSGGSTYYA DSVKGRFTISRDNSKNTLYLQMNSLRAEDTAVYYCAKALVGATGAFDIWGQGTLVTVSSGG GGSGGGGSGGGGSEIVLTQSPGTLSLSPGERATLSCRASQSLSSNFLAWYQQKPGQAPGLL IYGASNWATGTPDRFSGSGSGTDFTLTITRLEPEDFAVYYCQYYGTSPMYTFGQGTKVEIK | 300 |
| BCMA | EBB-1980-A2 (human) | EVQLLESGGGLVQPGGSLRLSCAASGFTFSSYAMSWVRQAPGKGLEWVSAISGSGGSTYYA DSVKGRFTISRDNSKNTLYLQMNSLRAEDTAVYYCVLWFGEGFDPWGQGTLVTVSSGGGGS GGGGSGGGGSDIVLTQSPLSLPVTPGEPASISCRSSQSLLHSNGYNYLDWYLQKPGQSPQL LIYLGSNRASGVPDRFSGSGSGTDFTLKISRVEAEDVGVYYCMQALQTPLTFGGGTKVDIK | 301 |
| BCMA | EBB-1981-C3 | QVQLVESGGGLVQPGGSLRLSCAASGFTFSSYAMSWVRQAPGKGLEWVSAISGSGGSTYYA DSVKGRFTISRDNSKNTLYLQMNSLRAEDTAVYYCAKVGYDSSGYYRDYYGMDVWGQGTTV TVSSGGGGSGGGGSGGGGSEIVLTQSPGTLSLSPGERATLSCRASQSVSSSYLAWYQQKPG QAPRLLIYGTSSRATGISDRFSGSGSGTDFTLTISRLEPEDFAVYYCQHYGNSPPKFTFGP GTKLEIK | 302 |
| BCMA | EBB-1978-G4 (human) | EVQLVESGGGLVQPGGSLRLSCAASGFTFSSYAMSWVRQAPGKGLEWVSAISGSGGSTYYA DSVKGRFTISRDNSKNTLYLQMNSLRAEDTAVYYCAKMGWSSGYLGAFDIWGQGTTVTVSS GGGGSGGGGSGGGGSEIVLTQSPGTLSLSPGERATLSCRASQSVASSFLAWYQQKPGQAPR LLIYGASGRATGIPDRFSGSGSGTDFTLTISRLEPEDFAVYYCQHYGGSPRLTFGGGTKVD IK | 303 |
| BCMA | Humanized huscFv BCMA1 | Q V Q L V Q S G A E V K K P G S S V K V S C K A S G G T F S N Y W M H W V R Q A P G Q G L E W M G A T Y R G H S D T Y Y N Q K F K G R V T I T A D K S T S T A Y M E L S S L R S E D T A V Y Y C A R G A I Y N G Y D V L D N W G Q G T L V T V S S G G G G S G G G G S G G G G S G G G G S D I Q M T Q S P S S L S A S V G D R V T I T C S A S Q D I S N Y L N W Y Q Q K P G K A P K L L I Y Y T S N L H S G V P S R F S G S G S G T D F T L T I S S L Q P E D F A T Y Y C Q Q Y R K L P W T F G Q G T K L E I K R | 304 |
| BCMA | Humanized huscFv BCMA2 | DIQMTQSPSS LSASVGDRVT ITCSASQDIS NYLNWYQQKP GKAPKLLIYY TSNLHSGVPSRFSGSGSGTD FTLTISSLQP EDFATYYCQQ YRKLPWTFGQ GTKLEIKRGG GGSGGGGSGGGGSGGGGSQV QLVQSGAEVK KPGSSVKVSC KASGGTFSNY WMHWVRQAPG QGLEWMGATYRGHSDTYYNQ KFKGRVTITA DKSTSTAYME LSSLRSEDTA VYYCARGAIYNGYDVLDNWGQGTLVTVSS | 305 |
| CD33 | 141643 (human) | QVQLVQSGAEVKKPGESLKISCKGSGYSFTSYWIGWVRQMPGKGLEWMGIIYPGDSDTRYS PSFQGQVTISADKSISTAYLQWSSLKASDTAMYYCARLGGSLPDYGMDVWGQGTMVTVSSA SGGGGSGGGGSGGGGSEIVLTQSPLSLPVTPGEPASISCRSSQSLLHSNGYNYLDWYLQKP GQSPQLLIYLGSNRASGVPDRFSGSGSGTDFTLKISRVEAEDVGVYYCMQALQTLITFGQG TKVDIK | 306 |
| CD33 | 141644 (human) | QVQLVQSGAEVKKPGASVRVSCKASGYIFTNYYVHWVRQAPGQGLEWMGIISPSGGSPTYA QRLQGRVTMTRDLSTSTVYMELSSLTSEDTAVYFCARESRLRGNRLGLQSSIFDHWGQGTL VTVSSASGGGGSGGGGSGGGGSDIRMTQSPPSLSASVGDRVTIPCQASQDINNHLNWYQQK PGKAPQLLIYDTSNLEIGVPSRFSGSGSGTDFTLTISSLQPEDIATYYCQQYENLPLTFGG GTKVEIK | 307 |
| CD33 | 141645 (human) | QVQLVQSGGGLVQPGGSLRLSCAASGFTFSSYAMSWVRQAPGKGLEWVSAISGSGGSTYYA DSVKGRFTISRDNSKNTLYLQMNSLRAEDTAVYYCAKEDTIRGPNYYYYGMDVWGQGTTVT VSSASGGGGSGGGGSGGGGSETTLTQSPSSVSASVGDRVSITCRASQDIDTWLAWYQLKPG KAPKLLMYAASNLQGGVPSRFSGSGSGTDFILTISSLQPEDFATYYCQQASIFPPTFGGGT KVDIK | 308 |
| CD33 | 141646 (human) | QVQLVQSGAEVKKPGESLKISCKGSGYSFTSYWIGWVRQMPGKGLEWMGIIYPGDSDTRYS PSFQGQVTISADKSITTAYLQWSSLRASDSAMYYCARGGYSDYDYYFDFWGQGTLVTVSSA SGGGGSGGGGSGGGGSEIVMTQSPLSLPVTPGEPASISCRSSQSLLHSNGYNYLDWYLQKP GQSPQLLIYLGSNRASGVPDRFSGSGSGTDFTLKISRVEAEDVGVYYCMQALQTPFTFGGG TKVEIK | 309 |
| CD33 | 141647 (human) | QVQLVQSGGDLAQPGRSLRLSCAASGFTFDDYAMHWVRQAPGKGLEWVAVIWPDGGQKYYG DSVKGRFTVSRDNPKNTLYLQMNSLRAEDTAIYYCVRHFNAWDYWGQGTLVTVSSASGGGG SGGGGSGGGGSDIQLTQSPSSLSAYVGGRVTITCQASQGISQFLNWFQQKPGKAPKLLISD ASNLEPGVPSRFSGSGSGTDFTFTITNLQPEDIATYYCQQYDDLPLTFGGGTKVEIK | 310 |

TABLE 4-continued

Exemplary Antigen Binding Domains

| Target Antigen | Name | Amino Acid Sequence | SEQ ID NO: |
|---|---|---|---|
| CD33 | 141648 (human) | QVQLVQSGGGVVQPGKSLRLSCAAS<u>GFTFSIFAMH</u>WVRQAPGKGLEWVA<u>TISYDGSNAFYA</u> <u>DSVEG</u>RFTISRDNSKDSLYLQMDSLRPEDTAVYYCVK<u>AGDGGYDVFDS</u>WGQGTLVTVSSAS GGGGSGGGGSGGGGSEIVMTQSPLSLPVTPGEPASISC<u>RSSQSLLHSNGYNYLD</u>WYLQKPG QSPQLLIY<u>LGSNRAS</u>GVPDRFSGSGSGTDFTLKISRVEAEDVGVYYC<u>MQALQTPT</u>FGPGTK VDIK | 311 |
| CD33 | 141649 (human) | EVQLVESGGGLVQPGGSLRLSCAAS<u>GFTFSSYAMS</u>WVRQAPGKGLEWVS<u>AISGSGGSTYYA</u> <u>DSVKG</u>RFTISRDNSKNTLYLQMNSLRAEDTAVYYCAK<u>ETDYYGSGTFDY</u>WGQGTLVTVSSA SGGGGSGGGGSGGGGSDIQMTQSPSSLSASVGDRVTISC<u>RASQGIGIYLA</u>WYQQRSGKPPQ LLIH<u>GASTLQS</u>GVPSRFSGSGSGTDFTLTISSLQPEDFASYWC<u>QQSNNFPPT</u>FGQGTKVEI K | 312 |
| CD33 | 141650 (human) | QVQLVQSGAEVKKPGASVRVSCKAS<u>GYMFTDFFIH</u>WVRQAPGQGLEWMG<u>WINPNSGVTKYA</u> <u>QKFQG</u>RVTMTRNTSISTAYMELSSLRSEDTAVYYCAT<u>WYSSGWYGIANI</u>WGQGTMVTVSSA SGGGGSGGGGSGGGGSDIQLTQSPSSLSASVGDRVTITC<u>QASHDISNYLH</u>WYQQKPGKAPK LLIY<u>DASNLET</u>GVPSRFTGSGSGTDFTLTIRSLQPEDVAAYYC<u>QQSDDLPHT</u>FGQGTKVDI K | 313 |
| CD33 | 141651 (human) | QVQLVQSGAEVKKPGESLKISCKGS<u>GYSFTNYWIG</u>WVRQMPGKGLEWMG<u>IIYPGDSDTRYS</u> <u>PSFQG</u>QVTISADKSISTAYLQWSSLKASDTAMYYCAR<u>HGPSSWGEFDY</u>WGQGTLVTVSSAS GGGGSGGGGSGGGGSDIRLTQSPSSLSASVGDRVTITC<u>RASQSISSYLN</u>WYQQKPGKAPKL LIY<u>AASSLQS</u>GVPSRFSGSGSGTDFTLTISSLQPEDFATYYC<u>QQSYSTPLT</u>FGGGTKVDIK | 314 |
| CD33 | 2213 (humanized) | NIMLTQSPSSLAVSAGEKVTMSCKSSQSVFFSSSQKNYLAWYQQIPGQSPKLLIY WASTRESGVPDRFTGSGSGTDFTLTISSVQSEDLAIYYCHQYLSSRTFGGGTKLE IKRGGGGSGGGGSSGGGSQVQLQQPGAEVVKPGASVKMSCKASGYTFTSYYIHWI KQTPGQGLEWVGVIYPGNDDISYNQKFKGKATLTADKSSTTAYMQLSSLTSEDSA VYYCAREVRLRYFDVWGAGTTVTVSS | 315 |
| CD33 | My96 (humanized) | EIVLTQSPGSLAVSPGERVTMSCKSSQSVFFSSSQKNYLAWYQQIPGQSPRLLIY WASTRESGVPDRFTGSGSGTDFTLTISSVQPEDLAIYYCHQYLSSRTFGQGTKLE IKRGGGGSGGGGSSGGGSQVQLQQPGAEVVKPGASVKMSCKASGYTFTSYYIHWI KQTPGQGLEWVGVIYPGNDDISYNQKFQGKATLTADKSSTTAYMQLSSLTSEDSA VYYCAREVRLRYFDVWGQGTTVTVSS | 316 |
| Claudin6 | muMAB 64A | EVQLQQSGPELVKPGASMKISCKAS<u>GYSFTGYTMN</u>WVKQSHGKNLEWIG<u>LINPYN</u> <u>GGTIYNQKFKG</u>KATLTVDKSSTAYMELLSLTSEDSAVYYCAR<u>DYGFVLDY</u>WGQG TTLTVSSGGGGSGGGGSGGGGSGGGGSQIVLTQSPSIMSVSPGEKVTITC<u>SASSS</u> <u>VSYMH</u>WFQQKPGTSPKLCIY<u>STSNLAS</u>GVPARFSGRGSGTSYSLTISRVAAEDAA TYYC<u>QQRSNYPPWT</u>FGGGTKLEIK | 317 |
| Claudin6 | mAb206- LCC | EVQLQQSGPELVKPGASMKISCKAS<u>GYSFTGYTMN</u>WVKQSHGKNLEWIG<u>LINPYN</u> <u>GGTIYNQKFKG</u>KATLTVDKSSSTAYMELLSLTSEDSAVYYCAR<u>DYGFVLDY</u>WGQG TTLTVSSGGGGSGGGGSGGGGSGGGGSQIVLTQSPAIMSASPGEKVTITC<u>SASSS</u> <u>VSYLH</u>WFQQKPGTSPKLWVY<u>STSNLPS</u>GVPARFGGSGSGTSYSLTISRMEAEDAA TYYC<u>QQRSIYPPWT</u>FGGGTKLEIK | 318 |
| Claudin6 | mAb206- SUBG | EVQLQQSGPELVKPGASMKISCKAS<u>GYSFTGYTMN</u>WVKQSHGKNLEWIG<u>LINPYN</u> <u>GGTIYNQKFKG</u>KATLTVDKSSTAYMELLSLTSEDSAVYYCAR<u>DYGFVLDY</u>WGQG TTLTVSSGGGGSGGGGSGGGGSGGGGSQIVLTQSPSIMSVSPGEKVTITC<u>SASSS</u> <u>VSYMH</u>WFQQKPGTSPKLGIY<u>STSNLAS</u>GVPARFSGRGSGTSYSLTISRVAAEDAA TYYC<u>QQRSNYPPWT</u>FGGGTKLEIK | 319 |
| WT1 | ESK-1 | QAVVTQPPSA SGTPGQRVTI SCSGSSSNIG SNTVNWYQQV PGTAPKLLIY SNNQRPSGVPDRFSGSKSGT SASLAISGLQ SEDEADYYCA AWDDSLNGWV FGGGTKLTVL GSRGGGGSGG GGSGGGGSLE MAQMQLVQSG AEVKEPGESL RISCKGSGYS FTNFWISWVR QMPGKGLEWM | 320 |
| WT1 | WT1-2 | QTVVTQPPSA SGTPGQRVTI SCSGSSSNIG SNYVYWYQQL PGTAPKLLIYRSNQRPSGVP DRFSGSKSGT SASLAISGPR SVDEADYYCA AWDDSLNGVV FGGGTKLTVL GSRGGGGSGG GGSGGGGSLEM AQVQLVQSGA EVKKPGSSVK VSCKASGGTF SSYAISWVRQ APGQGLEWMG GIIPIFGTAN YAQKFQGRVT ITADESTSTA YMELSSLRSE DTAVYYCARR IPPYYGMDVW GQGTTVTVSS | 321 |
| WT1 | WT1-3 | DIQMTQSPSS LSASVGDRVT ITCRASQSIS SYLNWYQQKP GKAPKLLIYA ASSLQSGVPS RFSGSGSGTD FTLTISSLQP EDFATYYCQQ SYSTPLTFGG GTKVDIKRSR GGGGSGGGGS GGGGSLEMAQ VQLQQSGPGL VKPSQTLSLT CAISGDSVSS NSAAWNWIRQ SPSRGLEWLG RTYYGSKWYN DYAVSVKSRI TINPDTSKNQ FSLQLNSVTP EDTAVYYCAR GRLGDAFDIW GQGTMVTVSS | 322 |
| WT1 | WT1-4 | DIQMTQSPST LSASVGDRVT ITCRASQNIN KWLAWYQQRP GKAPQLLIYK ASSLESGVPS RFSGSGSGTE YTLTISSLQP DDFATYYCQQ YNSYATFGQG TKVEIKRSRG GGGSGGGGSG GGGSLEMAQV QLVQSGAEVK KPGESLKISC | 323 |

TABLE 4-continued

Exemplary Antigen Binding Domains

| Target Antigen | Name | Amino Acid Sequence | SEQ ID NO: |
|---|---|---|---|
| | | KGSGYNFSNK WIGWVRQLPG RGLEWIAIIY PGYSDITYSP SFQGRVTISA<br>DTSINTAYLH WHSLKASDTA MYYCVRHTAL AGFDYWGLGT LVTVSS | |
| WT1 | WT1-5 | QSVVTQPPSV SVAPGKTARI TCGRNNIGSK SVHWYQQKPG QAPVLVVYDD<br>SDRPSGIPER FSGSNSGNTA TLTISRVEAG DEADYYCQVW DSSSDHVVFG<br>GGTKLTVLGS RGGGGSGGGG SGGSLEMAEV QLVQSGGGVV RPGGSLRLSC<br>AASGFTFDDY GMSWVRQAPG KGLEWVSGIN WNGGSTGYAD SVRGRFTISR<br>DNAKNSLYLQ MNSLRAEDTA LYYCARERGY GYHDPHDYWG QGTLVTVSS | 324 |
| WT1 | WT1-6 | QSVLTQPPSV SGAPGQRVTI SCTGSSSNIG AGYDVHWYQQ LPGTAPKLLI<br>YGNSNRPSGV PDRFSGSKSG TSASLAISGL QSEDEADYYC AAWDDSLNGY<br>VFGTGTKLTV LGSRGGGGSG GGGSGGGGSL EMAEVQLVET GGGLLQPGGS<br>LRLSCAASGF SVSGTYMGWV RQAPGKGLEW VALLYSGGGT YHPASLQGRF<br>IVSRDSSKNM VYLQMNSLKA EDTAVYYCAK GGAGGGHFDS WGQGTLVTVS S | 325 |
| WT1 | WT1-7 | EVQLLESGGG LVQPGGSLRL SCAASGFTFS SYAMSWVRQA PGKGLEWVSQ<br>IDPWGQETLY ADSVKGRFTI SRDNSKNTLY LQMNSLRAED TAVYYCAKLT<br>GRFDYWGQGT LVTVSSGGGG SGGGGSGGGG STDIQMTQSP SSLSASVGDR<br>VTITCRASQS ISSYLNWYQQ KPGKAPKLLI YSASQLQSGV PSRFSGSGSG<br>TDFTLTISSL QPEDFATYYC QQGPGTPNTF GQGTKVEIKR A | 326 |

In one embodiment, an antigen binding domain against mesothelin is an antigen binding portion, e.g., CDRs, of an anti-mesothelin binding domain described in Table 4, e.g., ss1, M1, M2, M3, M4, M5, M6, M7, M8, M9, 10, M11, M12, M13, M14, M15, M16, M17, M18, M19, M20, M21, M22, M23, or M24, e.g., ss1, M5 or M11. In one embodiment, an antigen binding domain against mesothelin is a human antigen binding portion, e.g., CDRs, of a human anti-mesothelin binding domain described in Table 4, e.g., M1, M2, M3, M4, M5, M6, M7, M8, M9, 10, M11, M12, M13, M14, M15, M16, M17, M18, M19, M20, M21, M22, M23, or M24, e.g., M5 or M11. In one embodiment, an antigen binding domain that binds mesothelin is an antigen binding domain according to Tables 2-3 of WO 2015/090230, incorporated herein by reference.

In one embodiment, the human antigen binding domain that binds mesothelin binds to the same epitope as the epitope bound by murine antigen binding domain SS1 (provided in Table 4). In one embodiment, the human antigen binding domain that bind mesothelin binds to a different epitope than the epitope bound by murine antigen binding domain SS1 (provided in Table 4). As described in WO 2015/090230, hereby incorporated by reference, the M-5 and M-11 human anti-mesothelin binding domains described in Table 4 bind to a different epitope than that of SS1.

In one embodiment, an antigen binding domain against CLL-1 is an antigen binding portion, e.g., CDRs, of an antibody available from R&D, ebiosciences, Abcam, for example, PE-CLL1-hu Cat #353604 (BioLegend); and PE-CLL1 (CLEC12A) Cat #562566 (BD). In one embodiment, an antigen binding portion against CLL-1 is an antigen binding portion, e.g., CDRs, of an anti-CLL-1 binding domain described in Table 4, e.g., 139115, 139116, 139117, 139118, 139119, 139120, 139121, 139121, 139122, 146259, 146261, 146262, 146263, 146264 or 181286.

In one embodiment, an antigen binding domain against CD123 is an antigen binding portion, e.g., CDRs, of an anti-CD123 binding domain described in Table 4, e.g., CD123-1, CD123-2, CD123-3, CD123-4, or hzCAR1-32. In one embodiment, an antigen binding domain against CD123 is an antigen binding domain according to Tables 1-2 of WO 2014/130635, incorporated herein by reference. In one embodiment, an antigen binding domain against CD33 is an antigen binding portion, e.g., CDRs, of an antibody described in, e.g., Bross et al., Clin Cancer Res 7(6):1490-1496 (2001) (Gemtuzumab Ozogamicin, hP67.6), Caron et al., Cancer Res 52(24):6761-6767 (1992) (Lintuzumab, HuM195), Lapusan et al., Invest New Drugs 30(3):1121-1131 (2012) (AVE9633), Aigner et al., Leukemia 27(5):1107-1115 (2013) (AMG330, CD33 BiTE), Dutour et al., Adv hematol 2012:683065 (2012), and Pizzitola et al., Leukemia doi:10.1038/Lue.2014.62 (2014). In one embodiment, an antigen binding portion against CD33 is an antigen binding portion, e.g., CDRs, of an anti-CD33 binding domain described in Table 4, e.g., 141643, 141644, 141645, 141646, 141647, 141648, 141649, 141650, 141651, 2213 or My96.

In one embodiment, an antigen binding domain against GD2 is an antigen binding portion, e.g., CDRs, of an antibody described in, e.g., Mujoo et al., Cancer Res. 47(4):1098-1104 (1987); Cheung et al., Cancer Res 45(6):2642-2649 (1985), Cheung et al., J Clin Oncol 5(9):1430-1440 (1987), Cheung et al., J Clin Oncol 16(9):3053-3060 (1998), Handgretinger et al., Cancer Immunol Immunother 35(3):199-204 (1992). In some embodiments, an antigen binding domain against GD2 is an antigen binding portion of an antibody selected from mAb 14.18, 14G2a, ch14.18, hu14.18, 3F8, hu3F8, 3G6, 8B6, 60C3, 10B8, ME36.1, and 8H9, see e.g., WO2012033885, WO2013040371, WO2013192294, WO2013061273, WO2013123061, WO2013074916, and WO201385552. In some embodiments, an antigen binding domain against GD2 is an antigen binding portion of an antibody described in US Publication No.: 20100150910 or PCT Publication No.: WO 2011160119.

In one embodiment, an antigen binding domain against BCMA is an antigen binding portion, e.g., CDRs, of an antibody described in, e.g., WO2012163805, WO200112812, and WO2003062401. In one embodiment, an antigen binding portion against bcma is an antigen binding portion, e.g., CDRs, of an anti-bcma binding domain described in Table 4, e.g., 139100, 139101, 139102, 139103, 139104, 139105, 139106, 139107, 139108, 139109, 139110, 139111, 139112, 139113, 139114, 149362, 149363, 149364, 149365, 149366, 149367, 149368, 149369, EB c1978-A4, EB C1978-G1, EBB C1978-C7, EBB C1978-D10, EBB C1978-A10, EBB C1978-D4, EBB C1978-G4, EBB C1979-C1, EBB C1979-C12, EBB C1980-G4, EBB C1980-D2, EBB C1980-A2, EBB C1981-C3, huscFvB-CMA1, or huscFvBCMA2.

In one embodiment, an antigen binding domain against WT-1 is an antigen binding portion, e.g., CDRs, of an antibody described in, e.g., Dao et al., Sci Transl Med 5(176):176ra33 (2013); or WO2012/135854. In one embodiment, an antigen binding domain against WT1 is an antigen binding portion, e.g., CDRs, of an anti-WT1 binding domain described in Table 4, e.g., ESK1, WT1-2, WT1-3, WT1-4, WT1-5, WT1-6 or WT1-7.

In one embodiment, an antigen binding domain against CLDN6 is an antigen binding portion, e.g., CDRs, of the antibody IMABO27 (Ganymed Pharmaceuticals), see e.g., clinicaltrial.gov/show/NCT02054351. In one embodiment, an antigen binding domain against CLDN6 is an antigen binding portion, e.g., CDRs, of an anti-CLDN6 binding domain described in Table 4, e.g., muMAB64A, mAb206-LCC or mAb206-SUBG.

In one embodiment, the antigen binding domain comprises one, two three (e.g., all three) heavy chain CDRs, HC CDR1, HC CDR2 and HC CDR3, from an antibody listed above, and/or one, two, three (e.g., all three) light chain CDRs, LC CDR1, LC CDR2 and LC CDR3, from an antibody listed above. In one embodiment, the antigen binding domain comprises a heavy chain variable region and/or a variable light chain region of an antibody listed above.

Non-Antibody Scaffolds

In embodiments, the antigen binding domain comprises a non antibody scaffold, e.g., a fibronectin, ankyrin, domain antibody, lipocalin, small modular immuno-pharmaceutical, maxybody, Protein A, or affilin. The non antibody scaffold has the ability to bind to target antigen on a cell. In embodiments, the antigen binding domain is a polypeptide or fragment thereof of a naturally occurring protein expressed on a cell. In some embodiments, the antigen binding domain comprises a non-antibody scaffold. A wide variety of non-antibody scaffolds can be employed so long as the resulting polypeptide includes at least one binding region which specifically binds to the target antigen on a target cell.

Non-antibody scaffolds include: fibronectin (Novartis, Mass.), ankyrin (Molecular Partners AG, Zurich, Switzerland), domain antibodies (Domantis, Ltd., Cambridge, Mass., and Ablynx nv, Zwijnaarde, Belgium), lipocalin (Pieris Proteolab AG, Freising, Germany), small modular immuno-pharmaceuticals (Trubion Pharmaceuticals Inc., Seattle, Wash.), maxybodies (Avidia, Inc., Mountain View, Calif.), Protein A (Affibody AG, Sweden), and affilin (gamma-crystallin or ubiquitin) (Scil Proteins GmbH, Halle, Germany).

Fibronectin scaffolds can be based on fibronectin type III domain (e.g., the tenth module of the fibronectin type III ($^{10}$Fn3 domain)). The fibronectin type III domain has 7 or 8 beta strands which are distributed between two beta sheets, which themselves pack against each other to form the core of the protein, and further containing loops (analogous to CDRs) which connect the beta strands to each other and are solvent exposed. There are at least three such loops at each edge of the beta sheet sandwich, where the edge is the boundary of the protein perpendicular to the direction of the beta strands (see U.S. Pat. No. 6,818,418). Because of this structure, this non-antibody scaffold mimics antigen binding properties that are similar in nature and affinity to those of antibodies. These scaffolds can be used in a loop randomization and shuffling strategy in vitro that is similar to the process of affinity maturation of antibodies in vivo.

The ankyrin technology is based on using proteins with ankyrin derived repeat modules as scaffolds for bearing variable regions which can be used for binding to different targets. The ankyrin repeat module is a 33 amino acid polypeptide consisting of two anti-parallel α-helices and a β-turn. Binding of the variable regions is mostly optimized by using ribosome display.

Avimers are derived from natural A-domain containing protein such as HER3. These domains are used by nature for protein-protein interactions and in human over 250 proteins are structurally based on A-domains. Avimers consist of a number of different "A-domain" monomers (2-10) linked via amino acid linkers. Avimers can be created that can bind to the target antigen using the methodology described in, for example, U.S. Patent Application Publication Nos. 20040175756; 20050053973; 20050048512; and 20060008844.

Affibody affinity ligands are small, simple proteins composed of a three-helix bundle based on the scaffold of one of the IgG-binding domains of Protein A. Protein A is a surface protein from the bacterium *Staphylococcus aureus*. This scaffold domain consists of 58 amino acids, 13 of which are randomized to generate affibody libraries with a large number of ligand variants (See e.g., U.S. Pat. No. 5,831,012). Affibody molecules mimic antibodies, they have a molecular weight of 6 kDa, compared to the molecular weight of antibodies, which is 150 kDa. In spite of its small size, the binding site of affibody molecules is similar to that of an antibody.

Protein epitope mimetics (PEM) are medium-sized, cyclic, peptide-like molecules (MW 1-2 kDa) mimicking beta-hairpin secondary structures of proteins, the major secondary structure involved in protein-protein interactions Mismatched Antigen Binding Domains It has been discovered, that cells having a plurality of chimeric membrane embedded receptors each comprising an antigen binding domain (CMERs) that interactions between the antigen binding domain of the CMER can be undesirable, e.g., because it inhibits the ability of one or more of the antigen binding domains to bind its cognate antigen. Accordingly, disclosed herein are a first and a second non-naturally occurring CMER comprising antigen binding domains that minimize such interactions when expressed in the same cell. In an embodiment a plurality of CMERs comprises two TCARs. In an embodiment a plurality of CMERs comprises a TCAR and another CMER. In an embodiment a plurality of CMERs comprises two NKR-CARs. In an embodiment a plurality of CMERs comprises a NKR-CAR and another CMER. In an embodiment a plurality of CMERs comprises a TCAR and an NKR-CAR.

In some embodiments, the claimed invention comprises a first and second CMER, wherein the antigen binding domain of one of said first CMER said second CMER does not comprise a variable light domain and a variable heavy domain. In some embodiments, the antigen binding domain of one of said first CMER said second CMER is a scFv, and the other is not an scFv. In some embodiments, the antigen binding domain of one of said first CMER said second CMER comprises a single VH domain, e.g., a camelid, shark, or lamprey single VH domain, or a single VH domain derived from a human or mouse sequence or a non-antibody scaffold. In some embodiments, the antigen binding domain of one of said first CMER said second CMER comprises a nanobody. In some embodiments, the antigen binding domain of one of said first CMER said second CMER comprises a camelid VHH domain.

In some embodiments, the antigen binding domain of one of said first CMER said second CMER comprises an scFv, and the other comprises a single VH domain, e.g., a camelid, shark, or lamprey single VH domain, or a single VH domain derived from a human or mouse sequence. In some embodiments, the antigen binding domain of one of said first CMER said second CMER comprises a scFv, and the other comprises a nanobody. In some embodiments, the antigen binding domain of one of said first CMER said second CMER comprises comprises a scFv, and the other comprises a camelid VHH domain.

In some embodiments, when present on the surface of a cell, binding of the antigen binding domain of said first CMER to its cognate antigen is not substantially reduced by the presence of said second CMER. In some embodiments, binding of the antigen binding domain of said first CMER to its cognate antigen in the presence of said second CMER is 85%, 90%, 95%, 96%, 97%, 98% or 99% of binding of the antigen binding domain of said first CMER to its cognate antigen in the absence of said second CMER.

In some embodiments, when present on the surface of a cell, the antigen binding domains of said first CMER said second CMER, associate with one another less than if both were scFv antigen binding domains. In some embodiments, the antigen binding domains of said first CMER said second CMER, associate with one another 85%, 90%, 95%, 96%, 97%, 98% or 99% less than if both were scFv antigen binding domains.

In some embodiments, the claimed invention comprises a first and second KIR-CAR, wherein the antigen binding domain of one of said first KIR-CAR said second KIR-CAR does not comprise a variable light domain and a variable heavy domain. In some embodiments, the antigen binding domain of one of said first KIR-CAR said second KIR-CAR is a scFv, and the other is not an scFv. In some embodiments, the antigen binding domain of one of said first KIR-CAR said second KIR-CAR comprises a single VH domain, e.g., a camelid, shark, or lamprey single VH domain, or a single VH domain derived from a human or mouse sequence or a non-antibody scaffold. In some embodiments, the antigen binding domain of one of said first KIR-CAR said second KIR-CAR comprises a nanobody. In some embodiments, the antigen binding domain of one of said first KIR-CAR said second KIR-CAR comprises a camelid VHH domain.

In some embodiments, the antigen binding domain of one of said first KIR-CAR said second KIR-CAR comprises an scFv, and the other comprises a single VH domain, e.g., a camelid, shark, or lamprey single VH domain, or a single VH domain derived from a human or mouse sequence. In some embodiments, the antigen binding domain of one of said first KIR-CAR said second KIR-CAR comprises a scFv, and the other comprises a nanobody. In some embodiments, the antigen binding domain of one of said first KIR-CAR said second KIR-CAR comprises a scFv, and the other comprises a camelid VHH domain.

In some embodiments, when present on the surface of a cell, binding of the antigen binding domain of said first KIR-CAR to its cognate antigen is not substantially reduced by the presence of said second KIR-CAR. In some embodiments, binding of the antigen binding domain of said first KIR-CAR to its cognate antigen in the presence of said second KIR-CAR is 85%, 90%, 95%, 96%, 97%, 98% or 99% of binding of the antigen binding domain of said first KIR-CAR to its cognate antigen in the absence of said second KIR-CAR.

In some embodiments, when present on the surface of a cell, the antigen binding domains of said first KIR-CAR said second KIR-CAR, associate with one another less than if both were scFv antigen binding domains. In some embodiments, the antigen binding domains of said first KIR-CAR said second KIR-CAR, associate with one another 85%, 90%, 95%, 96%, 97%, 98% or 99% less than if both were scFv antigen binding domains.

In some embodiments, the claimed invention comprises a first and second TCAR, wherein the antigen binding domain of one of said first TCAR said second TCAR does not comprise a variable light domain and a variable heavy domain. In some embodiments, the antigen binding domain of one of said first TCAR said second TCAR is an scFv, and the other is not an scFv. In some embodiments, the antigen binding domain of one of said first TCAR said second TCAR comprises a single VH domain, e.g., a camelid, shark, or lamprey single VH domain, or a single VH domain derived from a human or mouse sequence or a non-antibody scaffold. In some embodiments, the antigen binding domain of one of said first TCAR said second TCAR comprises a nanobody. In some embodiments, the antigen binding domain of one of said first TCAR said second TCAR comprises a camelid VHH domain.

In some embodiments, the antigen binding domain of one of said first TCAR said second TCAR comprises an scFv, and the other comprises a single VH domain, e.g., a camelid, shark, or lamprey single VH domain, or a single VH domain derived from a human or mouse sequence. In some embodiments, the antigen binding domain of one of said first TCAR said second TCAR comprises a scFv, and the other comprises a nanobody. In some embodiments, the antigen binding domain of one of said first TCAR said second TCAR comprises a scFv, and the other comprises a camelid VHH domain.

In some embodiments, when present on the surface of a cell, binding of the antigen binding domain of said first TCAR to its cognate antigen is not substantially reduced by the presence of said second TCAR. In some embodiments, binding of the antigen binding domain of said first TCAR to its cognate antigen in the presence of said second TCAR is 85%, 90%, 95%, 96%, 97%, 98% or 99% of binding of the antigen binding domain of said first TCAR to its cognate antigen in the absence of said second TCAR.

In some embodiments, when present on the surface of a cell, the antigen binding domains of said first TCAR said second TCAR, associate with one another less than if both were scFv antigen binding domains. In some embodiments, the antigen binding domains of said first TCAR said second TCAR, associate with one another 85%, 90%, 95%, 96%, 97%, 98% or 99% less than if both were scFv antigen binding domains.

Bispecific CARs

In an embodiment, an antigen binding domain described herein, e.g., for a NKR-CAR or a TCAR described herein, comprises a multispecific antibody molecule, e.g., a bispecific antibody molecule. A bispecific antibody has specificity for no more than two antigens. A bispecific antibody molecule is characterized by a first immunoglobulin variable domain sequence which has binding specificity for a first epitope and a second immunoglobulin variable domain sequence that has binding specificity for a second epitope. In an embodiment the first and second epitopes are on the same antigen, e.g., the same protein (or subunit of a multimeric protein). In an embodiment the first and second epitopes overlap. In an embodiment the first and second epitopes do not overlap. In an embodiment the first and second epitopes are on different antigens, e.g., different proteins (or different subunits of a multimeric protein). In an embodiment a bispecific antibody molecule comprises a heavy chain variable domain sequence and a light chain variable domain sequence which have binding specificity for a first epitope and a heavy chain variable domain sequence and a light chain variable domain sequence which have binding specificity for a second epitope. In an embodiment a bispecific antibody molecule comprises a half antibody having binding specificity for a first epitope and a half antibody having binding specificity for a second epitope. In an embodiment a bispecific antibody molecule comprises a half antibody, or fragment thereof, having binding specificity for a first epitope and a half antibody, or fragment thereof, having binding specificity for a second epitope. In an embodiment a bispecific antibody molecule comprises a scFv, or fragment thereof, have binding specificity for a first epitope and a scFv, or fragment thereof, have binding specificity for a second epitope.

In certain embodiments, the antibody molecule is a multispecific (e.g., a bispecific or a trispecific) antibody molecule. Protocols for generating bispecific or heterodimeric antibody molecules are known in the art; including but not limited to, for example, the "knob in a hole" approach described in, e.g., U.S. Pat. No. 5,731,168; the electrostatic steering Fc pairing as described in, e.g., WO 09/089004, WO 06/106905 and WO 2010/129304; Strand Exchange Engineered Domains (SEED) heterodimer formation as described in, e.g., WO 07/110205; Fab arm exchange as described in, e.g., WO 08/119353, WO 2011/131746, and WO 2013/060867; double antibody conjugate, e.g., by antibody cross-linking to generate a bi-specific structure using a heterobifunctional reagent having an amine-reactive group and a sulfhydryl reactive group as described in, e.g., U.S. Pat. No. 4,433,059; bispecific antibody determinants generated by recombining half antibodies (heavy-light chain pairs or Fabs) from different antibodies through cycle of reduction and oxidation of disulfide bonds between the two heavy chains, as described in, e.g., U.S. Pat. No. 4,444,878; trifunctional antibodies, e.g., three Fab' fragments cross-linked through sulfhydryl reactive groups, as described in, e.g., U.S. Pat. No. 5,273,743; biosynthetic binding proteins, e.g., pair of scFvs cross-linked through C-terminal tails preferably through disulfide or amine-reactive chemical cross-linking, as described in, e.g., U.S. Pat. No. 5,534,254; bifunctional antibodies, e.g., Fab fragments with different binding specificities dimerized through leucine zippers (e.g., c-fos and c-jun) that have replaced the constant domain, as described in, e.g., U.S. Pat. No. 5,582,996; bispecific and oligospecific mono- and oligovalent receptors, e.g., VH-CH1 regions of two antibodies (two Fab fragments) linked through a polypeptide spacer between the CH1 region of one antibody and the VH region of the other antibody typically with associated light chains, as described in, e.g., U.S. Pat. No. 5,591,828; bispecific DNA-antibody conjugates, e.g., crosslinking of antibodies or Fab fragments through a double stranded piece of DNA, as described in, e.g., U.S. Pat. No. 5,635,602; bispecific fusion proteins, e.g., an expression construct containing two scFvs with a hydrophilic helical peptide linker between them and a full constant region, as described in, e.g., U.S. Pat. No. 5,637,481; multivalent and multispecific binding proteins, e.g., dimer of polypeptides having first domain with binding region of Ig heavy chain variable region, and second domain with binding region of Ig light chain variable region, generally termed diabodies (higher order structures are also encompassed creating for bispecifc, trispecific, or tetraspecific molecules, as described in, e.g., U.S. Pat. No. 5,837,242; minibody constructs with linked VL and VH chains further connected with peptide spacers to an antibody hinge region and CH3 region, which can be dimerized to form bispecific/multivalent molecules, as described in, e.g., U.S. Pat. No. 5,837,821; VH and VL domains linked with a short peptide linker (e.g., 5 or 10 amino acids) or no linker at all in either orientation, which can form dimers to form bispecific diabodies; trimers and tetramers, as described in, e.g., U.S. Pat. No. 5,844,094; String of VH domains (or VL domains in family members) connected by peptide linkages with cross-linkable groups at the C-terminus further associated with VL domains to form a series of FVs (or scFvs), as described in, e.g., U.S. Pat. No. 5,864,019; and single chain binding polypeptides with both a VH and a VL domain linked through a peptide linker are combined into multivalent structures through non-covalent or chemical crosslinking to form, e.g., homobivalent, heterobivalent, trivalent, and tetravalent structures using both scFV or diabody type format, as described in, e.g., U.S. Pat. No. 5,869,620. Additional exemplary multispecific and bispecific molecules and methods of making the same are found, for example, in U.S. Pat. Nos. 5,910,573, 5,932,448, 5,959,083, 5,989,830, 6,005,079, 6,239,259, 6,294,353, 6,333,396, 6,476,198, 6,511,663, 6,670,453, 6,743,896, 6,809,185, 6,833,441, 7,129,330, 7,183,076, 7,521,056, 7,527,787, 7,534,866, 7,612,181, US2002004587A1, US2002076406A1, US2002103345A1, US2003207346A1, US2003211078A1, US2004219643A1, US2004220388A1, US2004242847A1, US2005003403A1, US2005004352A1, US2005069552A1, US2005079170A1, US2005100543A1, US2005136049A1, US2005136051A1, US2005163782A1, US2005266425A1, US2006083747A1, US2006120960A1, US2006204493A1, US2006263367A1, US2007004909A1, US2007087381A1, US2007128150A1, US2007141049A1, US2007154901A1, US2007274985A1, US2008050370A1, US2008069820A1, US2008152645A1, US2008171855A1, US2008241884A1, US2008254512A1, US2008260738A1, US2009130106A1, US2009148905A1, US2009155275A1, US2009162359A1, US2009162360A1, US2009175851A1, US2009175867A1, US2009232811A1, US2009234105A1, US2009263392A1, US2009274649A1, EP346087A2, WO0006605A2, WO02072635A2, WO04081051A1, WO06020258A2, WO2007044887A2, WO2007095338A2, WO2007137760A2, WO2008119353A1, WO2009021754A2, WO2009068630A1, WO9103493A1, WO9323537A1, WO9409131A1, WO9412625A2, WO9509917A1, WO9637621A2, WO9964460A1. The contents of the above-referenced applications are incorporated herein by reference in their entireties.

Within each antibody or antibody fragment (e.g., scFv) of a bispecific antibody molecule, the VH can be upstream or downstream of the VL. In some embodiments, the upstream antibody or antibody fragment (e.g., scFv) is arranged with its VH ($VH_1$) upstream of its VL ($VL_1$) and the downstream antibody or antibody fragment (e.g., scFv) is arranged with its VL ($VL_2$) upstream of its VH ($VH_2$), such that the overall bispecific antibody molecule has the arrangement $VH_1$-$VL_1$-$VL_2$-$VH_2$. In other embodiments, the upstream antibody or antibody fragment (e.g., scFv) is arranged with its VL ($VL_1$) upstream of its VH ($VH_1$) and the downstream antibody or antibody fragment (e.g., scFv) is arranged with its VH ($VH_2$) upstream of its VL ($VL_2$), such that the overall bispecific antibody molecule has the arrangement $VL_1$-$VH_1$-$VH_2$-

VL₂. Optionally, a linker is disposed between the two antibodies or antibody fragments (e.g., scFvs), e.g., between VL₁ and VL₂ if the construct is arranged as VH₁-VL₁-VL₂-VH₂, or between VH₁ and VH₂ if the construct is arranged as VL₁-VH₁-VH₂-VL₂. The linker may be a linker as described herein, e.g., a (Gly₄-Ser)n linker, wherein n is 1, 2, 3, 4, 5, or 6, preferably 4 (SEQ ID NO: 63). In general, the linker between the two scFvs should be long enough to avoid mispairing between the domains of the two scFvs. Optionally, a linker is disposed between the VL and VH of the first scFv. Optionally, a linker is disposed between the VL and VH of the second scFv. In constructs that have multiple linkers, any two or more of the linkers can be the same or different. Accordingly, in some embodiments, a bispecific CAR comprises VLs, VHs, and optionally one or more linkers in an arrangement as described herein.

In one aspect, the bispecific antibody molecule is characterized by a first immunoglobulin variable domain sequence, e.g., a scFv, which has binding specificity for a tumor antigen described herein, e.g., comprises a scFv as described herein, e.g., as described in Table 4, or comprises the light chain CDRs and/or heavy chain CDRs from a scFv described herein, and a second immunoglobulin variable domain sequence that has binding specificity for a second epitope on a different antigen. In some aspects the second immunoglobulin variable domain sequence has binding specificity for an antigen expressed on a tumor, e.g., a tumor antigen described herein.

Exemplary CAR Sequences

In embodiments, the NKR-CAR or TCAR described herein may comprise one or more sequences provided in Table 5.

TABLE 5

Sequences of various components of CAR (aa—amino acid sequence, na—nucleic acid sequence)

| SEQ ID NO | Descrip. | Sequence |
| --- | --- | --- |
| 11 | EF-1 promoter (na) | CGTGAGGCTCCGGTGCCCGTCAGTGGGCAGAGCGCACATCGCCCACAGTCCCCGAGAA GTTGGGGGGAGGGGTCGGCAATTGAACCGGTGCCTAGAGAAGGTGGCGCGGGGTAAA CTGGGAAAGTGATGTCGTGTACTGGCTCCGCCTTTTTCCCGAGGGTGGGGGAGAACCGT ATATAAGTGCAGTAGTCGCCGTGAACGTTCTTTTTCGCAACGGGTTTGCCGCCAGAACAC AGGTAAGTGCCGTGTGTGGTTCCCGCGGGCCTGGCCTCTTTACGGGTTATGGCCCTTGC GTGCCTTGAATTACTTCCACCTGGCTGCAGTACGTGATTCTTGATCCCGAGCTTCGGGTT GGAAGTGGGTGGGAGAGTTCGAGGCCTTGCGCTTAAGGAGCCCCTTCGCCTCGTGCTTG AGTTGAGGCCTGGCCTGGGCGCTGGGGCCGCCGCGTGCGAATCTGGTGGCACCTTCGC GCCTGTCTCGCTGCTTTCGATAAGTCTCTAGCCATTTAAAATTTTTGATGACCTGCTGCGA CGCTTTTTTTCTGGCAAGATAGTCTTGTAAATGCGGGCCAAGATCTGCACACTGGTATTT CGGTTTTTGGGGCCGCGGGCGGCGACGGGGCCCGTGCGTCCCAGCGCACATGTTCGGC GAGGCGGGGCCTGCGAGCGCGGCCACCGAGAATCGGACGGGGGTAGTCTCAAGCTGG CCGGCCTGCTCTGGTGCCTGGCCTCGCGCCGCCGTGTATCGCCCCGCCCTGGGCGGCAA GGCTGGCCGGTCGGCACCAGTTGCGTGAGCGGAAAGATGGCCGCTTCCCGGCCCTGC TGCAGGGAGCTCAAAATGGAGGACGCGGCGCTCGGGAGAGCGGGCGGGTGAGTCACC CACACAAAGGAAAAGGGCCTTTCCGTCCTCAGCCGTCGCTTCATGTGACTCCACGGAGT ACCGGGCGCCGTCCAGGCACCTCGATTAGTTCTCGAGCTTTTGGAGTACGTCGTCTTTAG GTTGGGGGGAGGGGTTTTATGCGATGGAGTTTCCCCACACTGAGTGGGTGGAGACTGA AGTTAGGCCAGCTTGGCACTTGATGTAATTCTCCTTGGAATTTGCCCTTTTTGAGTTTGGA TCTTGGTTCATTCTCAAGCCTCAGACAGTGGTTCAAAGTTTTTTTCTTCCATTTCAGGTGTC GTGA |
| 1 | Leader (aa) | MALPVTALLLPLALLLHAARP |
| 12 | Leader (na) | ATGGCCCTGCCTGTGACAGCCCTGCTGCTGCCTCTGGCTCTGCTGCTGCATGCCGCTAGA CCC |
| 2 | CD 8 hinge (aa) | TTTPAPRPPTPAPTIASQPLSLRPEACRPAAGGAVHTRGLDFACD |
| 13 | CD8 hinge (na) | ACCACGACGCCAGCGCCGCGACCACCAACACCGGCGCCCACCATCGCGTCGCAGCCCCT GTCCCTGCGCCCAGAGGCGTGCCGGCCAGCGGCGGGGGCGCAGTGCACACGAGGGG GCTGGACTTCGCCTGTGAT |
| 3 | Ig4 hinge (aa) | ESKYGPPCPPCPAPEFLGGPSVFLFPPKPKDTLMISRTPEVTCVVVDVSQEDPEVQFNWYVD GVEVHNAKTKPREEQFNSTYRVVSVLTVLHQDWLNGKEYKCKVSNKGLPSSIEKTISKAKGQ PREPQVYTLPPSQEEMTKNQVSLTCLVKGFYPSDIAVEWESNGQPENNYKTTPPVLDSDGSF FLYSRLTVDKSRWQEGNVFSCSVMHEALHNHYTQKSLSLSLGKM |
| 14 | Ig4 hinge (na) | GAGAGCAAGTACGGCCCTCCCTGCCCCCCTTGCCCTGCCCCCGAGTTCCTGGGCGGACCC AGCGTGTTCCTGTTCCCCCCAAGCCCAAGGACACCCTGATGATCAGCCGGACCCCCGA GGTGACCTGTGTGGTGGTGGACGTGTCCCAGGAGGACCCCGAGGTCCAGTTCAACTGG TACGTGGACGGCGTGGAGGTGCACAACGCCAAGACCAAGCCCCGGGAGGAGCAGTTCA ATAGCACCTACCGGGTGGTGTCCGTGCTGACCGTGCTGCACCAGGACTGGCTGAACGGC AAGGAATACAAGTGTAAGGTGTCCAACAAGGGCCTGCCCAGCAGCATCGAGAAAACCA TCAGCAAGGCCAAGGGCCAGCCTCGGGAGCCCCAGGTGTACACCCTGCCCCCTAGCCAA GAGGAGATGACCAAGAACCAGGTGTCCCTGACCTGCCTGGTGAAGGGCTTCTACCCCAG CGACATCGCCGTGGAGTGGGAGAGCAACGGCCAGCCCGAGAACAACTACAAGACCACC CCCCCTGTGCTGGACAGCGACGGCAGCTTCTTCCTGTACAGCCGGCTGACCGTGGACAA GAGCCGGTGGCAGGAGGGCAACGTCTTTAGCTGCTCCGTGATGCACGAGGCCCTGCAC AACCACTACACCCAGAAGAGCCTGAGCCTGTCCCTGGGCAAGATG |

TABLE 5-continued

Sequences of various components of CAR (aa—amino acid sequence, na—nucleic acid sequence)

| SEQ ID NO | Descrip. | Sequence |
|---|---|---|
| 4 | IgD hinge (aa) | RWPESPKAQASSVPTAQPQAEGSLAKATTAPATTRNTGRGGEEKKKEKEKEEQEERETKTPE CPSHTQPLGVYLLTPAVQDLWLRDKATFTCFVVGSDLKDAHLTWEVAGKVPTGGVEEGLLE RHSNGSQSQHSRLTLPRSLWNAGTSVTCTLNHPSLPPQRLMALREPAAQAPVKLSLNLLASS DPPEAASWLLCEVSGFSPPNILLMWLEDQREVNTSGFAPARPPPQPGSTTFWAWSVLRVP APPSPQPATYTCVVSHEDSRTLLNASRSLEVSYVTDH |
| 15 | IgD hinge (na) | AGGTGGCCCGAAAGTCCCAAGGCCCAGGCATCTAGTGTTCCTACTGCACAGCCCCAGGC AGAAGGCAGCCTAGCCAAAGCTACTACTGCACCTGCCACTACGCGCAATACTGGCCGTG GCGGGGAGGAGAAGAAAAAGGAGAAAGAGAAAGAAGAACAGGAAGAGAGGGAGAC CAAGACCCCTGAATGTCCATCCCATACCCAGCCGCTGGGCGTCTATCTCTTGACTCCCGC AGTACAGGACTTGTGGCTTAGAGATAAGGCCACCTTTACATGTTTCGTCGTGGGCTCTGA CCTGAAGGATGCCCATTTGACTTGGGAGGTTGCCGGAAAGGTACCCACAGGGGGGGTT GAGGAAGGGTTGCTGGAGCGCCATTCCAATGGCTCTCAGAGCCAGCACTCAAGACTCAC CCTTCCGAGATCCCTGTGGAACGCCGGGACCTCTGTCACATGTACTCTAAATCATCCTAG CCTGCCCCACAGCGTCTGATGGCCCTTAGAGAGCCAGCCGCCCAGGCACCAGTTAAGC TTAGCCTGAATCTGCTCGCCAGTAGTGATCCCCAGAGGCCGCCAGCTGGCTCTTATGCG AAGTGTCCGGCTTTAGCCCGCCCAACATCTTGCTCATGTGGCTGGAGGACCAGCGAGAA GTGAACACCAGCGGCTTCGCTCCAGCCCGGCCCCCACCCCAGCCGGGTTCTACCACATTC TGGGCCTGGAGTGTCTTAAGGGTCCCAGCACCACCTAGCCCCCAGCCAGCCACATACAC CTGTGTTGTGTCCCATGAAGATAGCAGGACCCTGCTAAATGCTTCTAGGAGTCTGGAGG TTTCCTACGTGACTGACCATT |
| 6 | CD8 Transmembrane (aa) | IYIWAPLAGTCGVLLLSLVITLYC |
| 17 | CD8 Transmembrane (na) | ATCTACATCTGGGCGCCCTTGGCCGGGACTTGTGGGGTCCTTCTCCTGTCACTGGTTATC ACCCTTTACTGC |
| 7 | 4-1BB intracellular domain (aa) | KRGRKKLLYIFKQPFMRPVQTTQEEDGCSCRFPEEEEGGCEL |
| 18 | 4-1BB intracellular domain (na) | AAACGGGGCAGAAAGAAACTCCTGTATATATTCAAACAACCATTTATGAGACCAGTACA AACTACTCAAGAGGAAGATGGCTGTAGCTGCCGATTTCCAGAAGAAGAAGAAGGAGGA TGTGAACTG |
| 8 | CD27 (aa) | QRRKYRSNKGESPVEPAEPCRYSCPREEEGSTIPIQEDYRKPEPACSP |
| 19 | CD27 (na) | AGGAGTAAGAGGAGCAGGCTCCTGCACAGTGACTACATGAACATGACTCCCCGCCGCCC CGGGCCCACCCGCAAGCATTACCAGCCCTATGCCCCACCACGCGACTTCGCAGCCTATCG CTCC |
| 9 | CD3-zeta (aa) (Q/K mutant) | RVKFSRSADAPAYKQGQNQLYNELNLGRREEYDVLDKRRGRDPEMGGKPRRKNPQEGLYN ELQKDKMAEAYSEIGMKGERRRGKGHDGLYQGLSTATKDTYDALHMQALPPR |
| 20 | CD3-zeta (na) (Q/K mutant) | AGAGTGAAGTTCAGCAGGAGCGCAGACGCCCCCGCGTACAAGCAGGGCCAGAACCAGC TCTATAACGAGCTCAATCTAGGACGAAGAGAGGAGTACGATGTTTTGGACAAGAGACGT GGCCGGGACCCTGAGATGGGGGGAAAGCCGAGAAGGAAGAACCCTCAGGAAGGCCTG TACAATGAACTGCAGAAAGATAAGATGGCGGAGGCCTACAGTGAGATTGGGATGAAAG GCGAGCGCCGGAGGGGCAAGGGGCACGATGGCCTTTACCAGGGTCTCAGTACAGCCAC CAAGGACACCTACGACGCCCTTCACATGCAGGCCCTGCCCCCTCGC |
| 10 | CD3-zeta (aa) (NCBI Reference Sequence NM_000734.3) | RVKFSRSADAPAYQQGQNQLYNELNLGRREEYDVLDKRRGRDPEMGGKPRRKNPQEGLY NELQKDKMAEAYSEIGMKGERRRGKGHDGLYQGLSTATKDTYDALHMQALPPR |
| 21 | CD3-zeta (na) (NCBI Reference Sequence NM_000734.3) | AGAGTGAAGTTCAGCAGGAGCGCAGACGCCCCCGCGTACCAGCAGGGCCAGAACCAGC TCTATAACGAGCTCAATCTAGGACGAAGAGAGGAGTACGATGTTTTGGACAAGAGACGT GGCCGGGACCCTGAGATGGGGGGAAAGCCGAGAAGGAAGAACCCTCAGGAAGGCCTG TACAATGAACTGCAGAAAGATAAGATGGCGGAGGCCTACAGTGAGATTGGGATGAAAG GCGAGCGCCGGAGGGGCAAGGGGCACGATGGCCTTTACCAGGGTCTCAGTACAGCCAC CAAGGACACCTACGACGCCCTTCACATGCAGGCCCTGCCCCCTCGC |
| 36 | CD28 Intracellular domain | RSKRSRLLHSDYMNMTPRRPGPTRKHYQPYAPPRDFAAYRS |

TABLE 5-continued

Sequences of various components of CAR (aa—amino acid sequence, na—nucleic acid sequence)

| SEQ ID NO | Descrip. | Sequence |
|---|---|---|
| | (amino acid sequence) | |
| 37 | CD28 Intracellular domain (nucleotide sequence) | AGGAGTAAGAGGAGCAGGCTCCTGCACAGTGACTACATGAACATGACTCCCCGCCGCCC CGGGCCCACCCGCAAGCATTACCAGCCCTATGCCCCACCACGCGACTTCGCAGCCTATCG CTCC |
| 38 | ICOS Intracellular domain (amino acid sequence) | T K K K Y S S S V H D P N G E Y M F M R A V N T A K K S R L T D V T L |
| 39 | ICOS Intracellular domain (nucleotide sequence) | ACAAAAAAGAAGTATTCATCCAGTGTGCACGACCCTAACGGTGAATACATGTTCATGAG AGCAGTGAACACAGCCAAAAAATCCAGACTCACAGATGTGACCCTA |
| 5 | GS hinge/linker (aa) | GGGGSGGGGS |
| 16 | GS hinge/linker (na) | GGTGGCGGAGGTTCTGGAGGTGGAGGTTCC |
| 356 | GS hinge/linker (na) | GGTGGCGGAGGTTCTGGAGGTGGGGGTTCC |
| 25 | linker | GGGGS |
| 26 | linker | (Gly-Gly-Gly-Gly-Ser)n, where n = 1-6, e.g., GGGGSGGGGS GGGGSGGGGS GGGGSGGGGS |
| 27 | linker | (Gly4 Ser)4 |
| 28 | linker | (Gly4 Ser)3 |
| 29 | linker | (Gly3Ser) |
| 40 | linker | (Gly-Gly-Gly-Ser)n where n is a positive integer equal to or greater than 1 |
| 41 | linker | (Gly-Gly-Gly-Ser)n, where n = 1-10, e.g., GGGSGGGSGG GSGGGSGGGS GGGSGGGSGG GSGGGSGGGS |
| 42 | linker | GSTSGSGKPGSGEGSTKG |
| 30 | polyA | (A)$_{5000}$<br>This sequence may encompass 50-5000 adenines. |
| 31 | polyT | (T)$_{100}$ |
| 32 | polyT | (T)$_{5000}$<br>This sequence may encompass 50-5000 thymines. |
| 33 | polyA | (A)$_{5000}$<br>This sequence may encompass 100-5000 adenines. |
| 34 | polyA | (A)$_{400}$<br>This sequence may encompass 100-400 adenines. |
| 35 | polyA | (A)$_{2000}$<br>This sequence may encompass 50-2000 adenines. |
| 22 | PD1 CAR (aa) | pqwfldspdrpwnpptfspallvvteqdnatftcsfsntsesfvlnwyrmspsnqtdklaafpedrsqpgqdcrf rvtqlpngrdfhmsvvrarrndsqtylcgaislapkaqikeslraelrvterraevptahpspsprpaggfqtlvtttp aprpptpaptiasqplslrpeacrpaaggavhtrgldfacdiyiwaplagtcgvlllslvitlyckrgrkkllyifkqpfm rpvqttqeedgcscrfpeeeeggcelrvkfsrsadapaykqgqnqlynelnlgrreeydvldkrrgrdpemggk prrknpqeglynelqkdkmaeayseigmkgerrrgkghdglyqglstatkdtydalhmqalppr |

TABLE 5-continued

Sequences of various components of CAR (aa—amino acid sequence, na—nucleic acid sequence)

| SEQ ID NO | Descrip. | Sequence |
|---|---|---|
| 23 | PD-1 CAR (na) (PD1 ECD underlined) | atggccctccctgtcactgccctgcttctcccctcgcactcctgctccacgccgctagacca<u>cccggatggtttctgga</u><br><u>ctctccggatcgcccgtggaatcccccaaccttctcaccggcactcttggttgtgactgagggcgataatgcgacctc</u><br><u>acgtgctcgttctccaacacctccgaatcattcgtgctgaactggtaccgcatgagcccgtcaaaccagaccgacaa</u><br><u>gctcgccgcgtttccggaagatcggtcgcaaccgggacaggattgtcggttccgcgtgactcaactgccgaatggca</u><br><u>gagacttccacatgagcgtggtccgcgctaggcgaaacgactccgggacctacctgtgcgagccatctcgctggcg</u><br><u>cctaaggcccaaatcaaagagagcttgagggccgaactgagagtgaccgagcgcagagctgaggtgccaactgca</u><br><u>catccatccccatcgcctcggcctgcggggcagtttcagaccctggt</u>cacgaccactccggcgccgcgccaccgact<br>ccggcccaactatcgcgagccagcccctgtcgctgaggccggaagcatgccgcctgccgcggaggtgctgtgc<br>atacccggggattggacttcgcatgcgacatctacatttgggctcctctcgccggaacttgtggcgtgctccttctgtcc<br>ctggtcatcaccctgtactgcaagcggggtcggaaaaagcttctgtacattttcaagcagcccttcatgaggcccgtg<br>caaaccacccaggaggaggacggttgctcctgccggttccccgaagaggaagaaggagttgcgagctgcgcgtg<br>aagttctcccggagcgccgacgcccccgcctataagcagggccagaaccagctgtacaacgaactgaacctgggac<br>ggcgggaagagtacgatgtgctggacaagcggcgcggccgggaccccgaaatgggcgggaagcctagaagaaag<br>aaccctcaggaaggcctgtataacgagctgcagaaggacaagatggccgaggcctactccgaaattgggatgaag<br>ggagagcggcggagggaaaggggcacgacggcctgtaccaaggactgtccaccgccaccaaggacacatcga<br>tgccctgcacatgcaggcccttcccctcgc |
| 24 | PD-1 CAR (aa) with signal (PD1 ECD underlined) | Malpvtalllplallllhaar<u>ppgwfldspdrpwnpptfspallvvtegdnatftcsfsntsesfvlnwyrmspsnqt</u><br><u>dklaafpedrsqpqqdcrfrvtqlpnqrdfhmsvvrarrndsqtylcqaislapkaqikeslraelrvterraevpta</u><br><u>hpspsprpaqqfqtlvtttpaprpptpaptiasqplslrpeacrpaaggavhtrgldfacdiyiwaplagtcgvlllsl</u><br>vitlyckrgrkkllyifkqpfmrpvqttqeedgcscrfpeeeeggcelrvkfsrsadapaykqgqnqlynelnlgrre<br>eydvldkrrgrdpemggkprrknpqeglynelqkdkmaeayseigmkgerrrgkghdglyqglstatkdtydal<br>hmqalppr |
| 338 | Cytoplasmic domain of PD1 (amino acids 192-288) | CSRAARGTIGARRTGQPLKEDPSAVPVFSVDYGELDFQWREKTPEPPVPCVPEQTEY<br>ATIVFPSGMGTSSPARRGSADGPRSAQPLRPEDGHCSWPL |
| 339 | Cytoplasmic domain of CTLA-4 (amino acids 183-223) | AVSLSKMLKKRSPLTTGVYVKMPPTEPECEKQFQPYFIPIN |
| 340 | Human CD8 hinge | TTTPAPRPPT PAPTIASQPL SLRPEACRPA AGGAVHTRGL DFA |

Exemplary sequences of NKR-CARs, and components of NKR-CARs, are further provided herein.

The nucleic acid sequence of a KIR-CAR comprising an antigen binding domain that binds to mesothelin and a cytoplasmic domain comprising a KIR2DS2 domain is provided below. Any of the antigen binding domains described herein can be substituted for the mesothelin antigen binding domain provided below.

SS1 KIR2DS2 gene sequence
(SEQ ID NO: 327)
gtgcacgagtgggttacatcgaactggatctcaacagcggtaagatcctt gagagttttcgccccgaagaacgttttccaatgatgagcacttttaaagt tctgctatgtggcgcggtattatcccgtattgacgccgggcaagagcaac tcggtcgccgcatacactattctcagaatgacttggttgagtactcacca gtcacagaaaagcatcttacggatggcatgacagtaagagaattatgcag tgctgccataaccatgagtgataacactgcggccaacttacttctgacaa cgatcggaggaccgaaggagctaaccgcttttttgcacaacatggggat catgtaactcgccttgatcgttgggaaccggagctgaatgaagccatacc aaacgacgagcgtgacaccacgatgcctgtagcaatggcaacaacgttgc gcaaactattaactggcgaactacttactctagcttcccggcaacaatta atagactggatggaggcggataaagttgcaggaccacttctgcgctcggc ccttccggctggctggtttattgctgataaatctggagccggtgagcgtg ggtctcgcggtatcattgcagcactggggccagatggtaagccctcccgt atcgtagttatctacacgacggggagtcaggcaactatggatgaacgaaa tagacagatcgctgagataggtgcctcactgattaagcattggtaactgt cagaccaagtttactcatatatactttagattgatttaaaacttcatttt taatttaaaaggatctaggtgaagatcctttttgataatctcatgaccaa aatcccttaacgtgagttttcgttccactgagcgtcagacccgtagaaa agatcaaaggatcttcttgagatcctttttttctgcgcgtaatctgctgc ttgcaaacaaaaaaaccaccgctaccagcggtggtttgtttgccggatca agagctaccaactctttttccgaaggtaactggcttcagcagagcgcaga taccaaatactgtccttctagtgtagccgtagtaggccaccacttcaag aactctgtagcaccgcctacatacctcgctctgctaatcctgttaccagt ggctgctgccagtggcgataagtcgtgtcttaccgggttggactcaagac gatagttaccggataaggcgcagcggtcgggctgaacggggggttcgtgc -continued

```
acacagcccagcttggagcgaacgacctacaccgaactgagatacctaca
gcgtgagctatgagaaagcgccacgcttcccgaagggagaaaggcggaca
ggtatccggtaagcggcagggtcggaacaggagagcgcacgagggagctt
ccaggggggaaacgcctggtatctttatagtcctgtcgggtttcgccacct
ctgacttgagcgtcgattttttgtgatgctcgtcagggggggcggagcctat
ggaaaaacgccagcaacgcggcctttttacggttcctggccttttgctgg
ccttttgctcacatgttctttcctgcgttatcccctgattctgtggataa
ccgtattaccgcctttgagtgagctgataccgctcgccgcagccgaacga
ccgagcgcagcgagtcagtgagcgaggaagcggaagagcgcccaatacgc
aaaccgcctctccccgcgcgttggccgattcattaatgcagctggcacga
caggtttcccgactggaaagcgggcagtgagcgcaacgcaattaatgtga
gttagctcactcattaggcaccccaggctttacactttatgcttccggct
cgtatgttgtgtggaattgtgagcggataacaatttcacacaggaaacag
ctatgaccatgattacgccaagcgcgcaattaaccctcactaaagggaac
aaaagctggagctgcaagcttaatgtagtcttatgcaatactcttgtagt
cttgcaacatggtaacgatgagttagcaacatgccttacaaggagagaaa
aagcaccgtgcatgccgattggtggaagtaaggtggtacgatcgtgcctt
attaggaaggcaacagacgggtctgacatggattggacgaaccactgaat
tgccgcattgcagagatattgtatttaagtgcctagctcgatacaataaa
cgggtctctctggttagaccagatctgagcctgggagctctctggctaac
tagggaaccccactgcttaagcctcaataaagcttgccttgagtgcttcaa
gtagtgtgtgcccgtctgttgtgtgactctggtaactagagatccctcag
acccttttagtcagtgtggaaaatctctagcagtggcgcccgaacaggga
cctgaaagcgaaagggaaaccagagctctctcgacgcaggactcggcttg
ctgaagcgcgcacggcaagaggcgaggggcggcgactggtgagtacgcca
aaaattttgactagcggaggctagaaggagagagatgggtgcgagagcgt
cagtattaagcgggggagaattagatcgcgatgggaaaaaattcggttaa
ggccagggggaaagaaaaaatataaattaaaacatatagtatgggcaagc
agggagctagaacgattcgcagttaatcctggcctgttagaaacatcaga
aggctgtagacaaatactgggacagctacaaccatcccttcagacaggat
cagaagaacttagatcattatataatacagtagcaaccctctattgtgtg
catcaaaggatagagataaaagacaccaaggaagctttagacaagataga
ggaagagcaaaacaaaagtaagaccaccgcacagcaagcggccgctgatc
ttcagacctggaggaggagatatgagggacaattggagaagtgaattata
taaatataaagtagtaaaaattgaaccattaggagtagcacccaccaagg
caaagagaagagtggtgcagagagaaaaaagagcagtgggaataggagct
ttgttccttgggttcttgggagcagcaggaagcactatgggcgcagcctc
aatgacgctgacggtacaggccagacaattattgtctggtatagtgcagc
agcagaacaatttgctgagggctattgaggcgcaacagcatctgttgcaa
ctcacagtctggggcatcaagcagctccaggcaagaatcctggctgtgga
aagatacctaaaggatcaacagctcctggggatttggggttgctctggaa
```

-continued

```
aactcatttgcaccactgctgtgccttggaatgctagttggagtaataaa
tctctggaacagattggaatcacacgacctggatggagtgggacagagaa
attaacaattacacaagcttaatacactccttaattgaagaatcgcaaaa
ccagcaagaaaagaatgaacaagaattattggaattagataaatgggcaa
gtttgtggaattggtttaacataacaaattggctgtggtatataaaatta
ttcataatgatagtaggaggcttggtaggtttaagaatagttttgctgt
actttctatagtgaatagagttaggcagggatattcaccattatcgtttc
agacccacctcccaaccccgaggggacccgacaggcccgaaggaatagaa
gaagaaggtggagagagagacagagacagatccattcgattagtgaacgg
atctcgacggtatcgattagactgtagcccaggaatatggcagctagatt
gtacacatttagaaggaaaagttatcttggtagcagttcatgtagccagt
ggatatatagaagcagaagtaattccagcagagacagggcaagaaacagc
atacttcctcttaaaattagcaggaagatggccagtaaaaacagtacata
cagacaatggcagcaatttcaccagtactacagttaaggccgcctgttgg
tgggcggggatcaagcaggaatttggcattccctacaatccccaaagtca
aggagtaatagaatctatgaataaagaattaaagaaaattataggacagg
taagagatcaggctgaacatcttaagacagcagtacaaatggcagtattc
atccacaattttaaaagaaaaggggggattgggggtacagtgcaggga
aagaatagtagacataatagcaacagacatacaaactaaagaattacaaa
aacaaattacaaaaattcaaaattttcgggtttattacagggacagcaga
gatccagtttggctgcatacgcgtcgtgaggctccggtgcccgtcagtgg
gcagagcgcacatcgcccacagtccccgagaagttgggggggagggtcgg
caattgaaccggtgcctagagaaggtggcgcggggtaaactgggaaagtg
atgtcgtgtactggctccgccttttttcccgagggtgggggagaaccgtat
ataagtgcagtagtcgccgtgaacgttctttttcgcaacgggtttgccgc
cagaacacaggtaagtgccgtgtgtggttcccgcgggcctggcctctttta
cgggttatggcccttgcgtgccttgaattacttccacctggctgcagtac
gtgattcttgatcccgagcttcgggttggaagtgggtgggagagttcgag
gccttgcgcttaaggagccccttcgcctcgtgccttgagttgaggcctggc
ctgggcgctggggccgccgcgtgcgaatctggtggcaccttcgcgcctgt
ctcgctgctttcgataagtctctagccatttaaaattttttgatgacctgc
tgcgacgctttttttctggcaagatagtcttgtaaatgcgggccaagatc
tgcacactggtatttcggtttttgggccgcggcggcgacggggcccgt
gcgtcccagcgcacatgttcggcgaggcggggcctgcgagcgcggccacc
gagaatcggacggggtagtctcaagctggccggcctgctctggtgcctg
gcctcgcgccgccgtgtatcgccccgccctgggcggcaaggctggcccgg
tcggcaccagttgcgtgagcggaaagatggccgcttcccggccctgctgc
agggagctcaaaatggaggacgcggcgctcgggagagcgggcgggtgagt
cacccacacaaaggaaaagggcctttccgtcctcagccgtcgcttcatgt
gactccacggagtaccgggcgccgtccaggcacctcgattagttctcgtg
```

-continued cttttggagtacgtcgtctttaggttgggggggaggggttttatgcgatgg
agtttccccacactgagtgggtggagactgaagttaggccagcttggcac
ttgatgtaattctccttggaatttgccctttttgagtttggatcttggtt
cattctcaagcctcagacagtggttcaaagttttttttcttccatttcagg
tgtcgtgagctagaATGGGGGGACTTGAACCCTGCAGCAGGCTCCTGCTC
CTGCCTCTCCTGCTGGCTGTAAGTGGTCTCCGTCCTGTCCAGGCCCAGGC
CCAGAGCGATTGCAGTTGCTCTACGGTGAGCCCGGGCGTGCTGGCAGGGA
TCGTGATGGGAGACCTGGTGCTGACAGTGCTCATTGCCCTGGCCGTGTAC
TTCCTGGGCCGGCTGGTCCCTCGGGGGCGAGGGGCTGCGGAGGCAGCGAC
CCGGAAACAGCGTATCACTGAGACCGAGTCGCCTTATCAGGAGCTCCAGG
GTCAGAGGTCGGATGTCTACAGCGACCTCAACACACAGAGGCCGTATTAC
AAAgTCGAGGGCGGCGGAGAGGGCAGAGGAAGTCTTCTAACATGCGGTGA
CGTGGAGGAGAATCCCGGCCCTAGGatggccttaccagtgaccgccttgc
tcctgccgctggccttgctgctccacgccgccaggccgggatcccaggta
caactgcagcagtctgggcctgagctggaagcctggcgcttcagtgaa
gatatcctgcaaggcttctggttactcattcactggctacaccatgaact
gggtgaagcagagccatggaaagagccttgagtggattggacttattact
ccttacaatggtgcttctagctacaaccagaagttcaggggcaaggccac
attaactgtagacaagtcatccagcacagcctacatggacctcctcagtc
tgacatctgaagactctgcagtctatttctgtgcaagggggggttacgac
ggagggggttttgactactggggccaagggaccacggtcaccgtctcctc
aggtggaggcggttcaggcggcggtggctctagcggtggtggatcggaca
tcgagctcactcagtctccagcaatcatgtctgcatctccaggggagaag
gtcaccatgacctgcagtgccagctcaagtgtaagttacatgcactggta
ccagcagaagtcaggcacctcccccaaaagatggatttatgacacatcca
aactggcttctggagtcccaggtcgcttcagtggcagtgggtctggaaac
tcttactctctcacaatcagcagcgtggaggctgaagatgatgcaactta
ttactgccagcagtggagtaagcaccctctcacgtacggtgctgggacaa
agttggaaatcaaagctagcACGCGTggtggcggaggttctggaggtggg
ggttcccaggggcctggccacatgagggagtccacagaaaaccttccct
cctggcccaccaggtcccctggtgaaatcagaagagacagtcatcctgc
aatgttggtcagatgtcaggtttgagcacttccttctgcacagagaggg
aagtataaggacacttttgcacctcattggagagcaccatgatggggtctc
caaggccaacttctccatcggtcccatgatgcaagaccttgcaggacct
acagatgctacggttctgttactcactcccctatcagttgtcagctccc
agtgaccctctggacatcgtcatcacaggtctatatgagaaaccttctct
ctcagcccagccgggccccacggttttggcaggagagagcgtgaccttgt
cctgcagctcccggagctcctatgacatgtaccatctatccaggaggg
gaggcccatgaacgtaggttctctgcagggcccaaggtcaacggaacatt
ccaggccgacttcctctgggccctgccacccacggaggaacctacagat
gcttcggctcttccgtgactctccctatgagtggtcaaactcgagtgac -continued ccactgcttgtttctgtcacaggaaacccttcaaatagttggccttcacc
cactgaaccaagctccaaaaccggtaaccccagacacctgcatgttctga
ttgggacctcagtggtcaaaatccctttcaccatcctcctcttctttctc
cttcatcgctggtgctccaacaaaaaaatgctgctgtaatggaccaaga
gcctgcagggaacagaacagtgaacagcgaggattctgatgaacaagacc
atcaggaggtgtcatacgcataaGtcgacaatcaacctctggattacaaa
atttgtgaaagattgactggtattcttaactatgttgctccttttacgct
atgtggatacgctgctttaatgcccttgtatcatgctattgcttcccgta
tggctttcattttctcctccttgtataaatcctggttgctgtctctttat
gaggagttgtggcccgttgtcaggcaacgtggcgtggtgtgcactgtgtt
tgctgacgcaaccccactggttggggcattgccaccacctgtcagctcc
tttccgggactttcgctttccccctcccattgccacgcggaactcatc
gccgcctgccttgcccgctgctggacaggggctcggctgttgggcactga
caattccgtggtgttgtcggggaagctgacgtccttccatggctgctcg
cctgtgttgccacctggattctgcgcgggacgtccttctgctacgtccct
tcggccctcaatccagcggaccttccttcccgcggcctgctgccggctct
gcggcctcttccgcgtcttcgccttcgccctcagacgagtcggatctccc
tttgggccgcctccccgcctggaattcgagctcggtaccttaagaccaa
tgacttacaaggcagctgtagatcttagccactttttaaaagaaaagggg
ggactggaagggctaattcactcccaacgaagacaagatctgcttttttgc
ttgtactgggtctctctggttagaccagatctgagcctgggagctctctg
gctaactagggaacccactgcttaagcctcaataaagcttgccttgagtg
cttcaagtagtgtgtgcccgtctgttgtgtgactctggtaactagagatc
cctcagacccttttagtcagtgtggaaaatctctagcagtagtagttcat
gtcatcttattattcagtatttataacttgcaaagaaatgaatatcagag
agtgagaggaacttgtttattgcagcttataatggttacaaataaagcaa
tagcatcacaaatttcacaaataaagcatttttttcactgcattctagtt
gtggtttgtccaaactcatcaatgtatcttatcatgtctggctctagcta
tcccgcccctaactccgcccagttccgcccattctccgccccatggctga
ctaattttttttatttatgcagaggccgaggccgcctcggcctctgagct
attccagaagtagtgaggaggcttttttggaggcctacgcttttgcgtcg
agacgtacccaattcgccctatagtgagtcgtattacgcgcgctcactgg
ccgtcgttttacaacgtcgtgactgggaaaaccctggcgttacccaactt
aatcgccttgcagcacatccccctttcgccagctggcgtaatagcgaaga
ggcccgcaccgatcgcccttcccaacagttgcgcagcctgaatggcgaat
ggcgcgacgcgccctgtagcggcgcattaagcgcggcgggtgtggtggtt
acgcgcagcgtgaccgctacacttgccagcgccctagcgcccgctcctt
cgctttcttcccttcctttctcgccacgttcgccggctttccccgtcaag
ctctaaatcggggctccctttagggttccgatttagtgctttacggcac
ctcgaccccaaaaaacttgattagggtgatggttcacgtagtgggccatc

```
gccctgatagacggttttttcgcctttgacgttggagtccacgttcttta
atagtggactcttgttccaaactggaacaacactcaaccctatctcggtc
tattcttttgatttataagggattttgccgatttcggcctattggttaaa
aaatgagctgatttaacaaaaatttaacgcgaattttaacaaaatattaa
cgtttacaatttcccaggtggcacttttcggggaaatgtgcgcggaaccc
ctatttgtttattttttctaaatacattcaaatatgtatccgctcatgaga
caataaccctgataaatgcttcaataatattgaaaaaggaagagtatgag
tattcaacatttccgtgtcgcccttattccttttttgcggcattttgcc
ttcctgttttttgctcacccagaaacgctggtgaaagtaaaagatgctgaa
gatcagttgg
```

The nucleic acid sequence of a KIR-CAR comprising an antigen binding domain that binds to mesothelin and a cytoplasmic domain comprising a KIRS2 domain is provided below. Any of the antigen binding domains described herein can be substituted for the mesothelin antigen binding domain provided below.

```
SS1 KIRS2 gene sequence
                              (SEQ ID NO: 328)
gtgcacgagtgggttacatcgaactggatctcaacagcggtaagatccctt
gagagttttcgccccgaagaacgttttccaatgatgagcacttttaaagt
tctgctatgtggcgcggtattatcccgtattgacgccgggcaagagcaac
tcggtcgccgcatacactattctcagaatgacttggttgagtactcacca
gtcacagaaaagcatcttacggatggcatgacagtaagagaattatgcag
tgctgccataaccatgagtgataacactgcggccaacttacttctgacaa
cgatcggaggaccgaaggagctaaccgcttttttgcacaacatgggggat
catgtaactcgccttgatcgttgggaaccggagctgaatgaagccatacc
aaacgacgagcgtgacaccacgatgcctgtagcaatggcaacaacgttgc
gcaaactattaactggcgaactacttactctagcttcccggcaacaatta
atagactggatggaggcggataaagttgcaggaccacttctgcgctcggc
ccttccggctggctggtttattgctgataaatctggagccggtgagcgtg
ggtctcgcggtatcattgcagcactggggccagatggtaagccctcccgt
atcgtagttatctacacgacggggagtcaggcaactatggatgaacgaaa
tagacagatcgctgagataggtgcctcactgattaagcattggtaactgt
cagaccaagtttactcatatatactttagattgatttaaaacttcattttt
taatttaaaaggatctaggtgaagatcctttttgataatctcatgaccaa
aatcccttaacgtgagttttcgttccactgagcgtcagacccccgtagaaa
agatcaaaggatcttcttgagatcctttttttctgcgcgtaatctgctgc
ttgcaaacaaaaaaaccaccgctaccagcggtggtttgtttgccggatca
agagctaccaactctttttccgaaggtaactggcttcagcagagcgcaga
taccaaatactgtccttctagtgtagccgtagttaggccaccacttcaag
aactctgtagcaccgcctacatacctcgctctgctaatcctgttaccagt
ggctgctgccagtggcgataagtcgtgtcttaccgggttggactcaagac
gatagttaccggataaggcgcagcggtcgggctgaacggggggttcgtgc
acacagcccagcttggagcgaacgacctacaccgaactgagatacctaca
gcgtgagctatgagaaagcgccacgcttcccgaagggagaaaggcggaca
ggtatccggtaagcggcagggtcggaacaggagagcgcacgagggagctt
ccaggggaaacgcctggtatctttatagtcctgtcgggtttcgccacct
ctgacttgagcgtcgatttttgtgatgctcgtcagggggcggagcctat
ggaaaaacgccagcaacgcggcctttttacggttcctggccttttgctgg
ccttttgctcacatgttctttcctgcgttatcccctgattctgtggataa
ccgtattaccgcctttgagtgagctgataccgctcgccgcagccgaacga
ccgagcgcagcgagtcagtgagcgaggaagcggaagagcgcccaatacgc
aaaccgcctctccccgcgcgttggccgattcattaatgcagctggcacga
caggtttcccgactggaaagcgggcagtgagcgcaacgcaattaatgtga
gttagctcactcattaggcacccaggctttacactttatgcttccggct
cgtatgttgtgtggaattgtgagcggataacaatttcacacaggaaacag
ctatgaccatgattacgccaagcgcgcaattaaccctcactaaagggaac
aaaagctggagctgcaagcttaatgtagtcttatgcaatactcttgtagt
cttgcaacatggtaacgatgagttagcaacatgccttacaaggagagaaa
aagcaccgtgcatgccgattggtggaagtaaggtggtacgatcgtgcctt
attaggaaggcaacagacgggtctgacatggattggacgaaccactgaat
tgccgcattgcagagatattgtatttaagtgcctagctcgatacaataaa
cgggtctctctggttagaccagatctgagcctgggagctctctggctaac
tagggaacccactgcttaagcctcaataaagcttgccttgagtgcttcaa
gtagtgtgtgcccgtctgttgtgtgactctggtaactagagatccctcag
accccttttagtcagtgtggaaaatctctagcagtggcgcccgaacaggga
cctgaaagcgaaagggaaaccagagctctctcgacgcaggactcggcttg
ctgaagcgcgcacggcaagaggcgaggggcggcgactggtgagtacgcca
aaaattttgactagcggaggctagaaggagagagatgggtgcgagagcgt
cagtattaagcgggggagaattagatcgcgatgggaaaaaattcggttaa
ggccagggggaaagaaaaaatataaattaaaacatatagtatgggcaagc
agggagctagaacgattcgcagttaatcctggcctgttagaaacatcaga
aggctgtagacaaatactgggacagctacaaccatcccttcagacaggat
cagaagaacttagatcattatataatacagtagcaaccctctattgtgtg
catcaaaggatagagataaaagacaccaaggaagctttagacaagataga
ggaagagcaaaacaaaagtaagaccaccgcacagcaagcggccgctgatc
ttcagacctggaggaggagatatgagggacaattggagaagtgaattata
taaatataaagtagtaaaaattgaaccattaggagtagcacccaccaagg
caaagagaagagtggtgcagagagaaaaaagagcagtgggaataggagct
ttgttccttgggttcttgggagcagcaggaagcactatgggcgcagcctc
aatgacgctgacggtacaggccagacaattattgtctggtatagtgcagc
agcagaacaatttgctgagggctattgaggcgcaacagcatctgttgcaa
ctcacagtctggggcatcaagcagctccaggcaagaatcctggctgtgga
``` aagatacctaaaggatcaacagctcctggggatttggggttgctctggaa
aactcatttgcaccactgctgtgccttggaatgctagttggagtaataaa
tctctggaacagattggaatcacacgacctggatggagtgggacagagaa
attaacaattcacacaagcttaatacactccttaattgaagaatcgcaaaa
ccagcaagaaaagaatgaacaagaattattggaattagataaatgggcaa
gtttgtggaattggtttaacataacaaattggctgtggtatataaaatta
ttcataatgatagtaggaggcttggtaggtttaagaatagttttttgctgt
actttctatagtgaatagagttaggcagggatattccaccattatcgtttc
agacccacctcccaaccccgaggggacccgacaggcccgaaggaatagaa
gaagaaggtggagagagagacagagacagatccattcgattagtgaacgg
atctcgacggtatcgattagactgtagcccaggaatatggcagctagatt
gtacacatttagaaggaaaagttatcttggtagcagttcatgtagccagt
ggatatatagaagcagaagtaattccagcagagacagggcaagaaacagc
atacttcctcttaaaattagcaggaagatggccagtaaaaacagtacata
cagacaatggcagcaatttcaccagtactacagttaaggccgcctgttgg
tgggcgggatcaagcaggaatttggcattccctacaatccccaaagtca
aggagtaatagaatctatgaataaagaattaaagaaaattataggacagg
taagagatcaggctgaacatcttaagacagcagtacaaatggcagtattc
atccacaattttaaaagaaaaggggggattggggggtacagtgcaggga
aagaatagtagacataatagcaacagacatacaaactaaagaattacaaa
aacaaattacaaaaattcaaaattttcggttattacagggacagcaga
gatccagtttggctgcatacgcgtcgtgaggctccggtgccgtcagtgg
gcagagcgcacatcgcccacagtccccgagaagttgggggagagggtcgg
caattgaaccggtgcctagagaaggtggcgcggggtaaactgggaaagtg
atgtcgtgtactggctccgccttttccccgagggtggggagaaccgtat
ataagtgcagtagtcgccgtgaacgttcttttttcgcaacgggtttgccgc
cagaacacaggtaagtgccgtgtgtggttccgcgggcctggcctcttta
cgggttatggcccttgcgtgccttgaattacttccacctggctgcagtac
gtgattcttgatcccgagcttcggggttggaagtgggtgggagagttcgag
gccttgcgcttaaggagccccttcgcctcgtgcttgagttgaggcctggc
ctgggcgctggggccgccgcgtgcgaatctggtggcaccttcgcgcctgt
ctcgctgctttcgataagtctctagccatttaaaattttttgatgacctgc
tgcgacgcttttttttctggcaagatagtcttgtaaatgcgggccaagatc
tgcacactggtatttcggtttttggggccgcgggcggcgacggggcccgt
gcgtcccagcgcacatgttcggcgaggcggggcctgcgagcgcggccacc
gagaatcggacgggggtagtctcaagctggccggcctgctctggtgcctg
gcctcgcgccgccgtgtatcgcccgcccctgggcggcaaggctggcccgg
tcggcaccagttgcgtgagcggaaagatggccgcttcccggcctgctgc
agggagctcaaaatggaggacgcggcgctcgggagagcggcgggtgagt
cacccacacaaggaaaagggccttccgtcctcagccgtcgcttcatgt
gactccacggagtaccgggcgccgtccaggcacctcgattagttctcgtg
cttttggagtacgtcgtctttaggttgggggggagggggttttatgcgatgg
agtttccccacactgagtgggtggagactgaagttaggccagcttggcac
ttgatgtaattctccttggaatttgccctttttgagtttggatcttggtt
cattctcaagcctcagacagtggttcaaagttttttttcttccatttcagg
tgtcgtgagctagaATGGGGGGACTTGAACCCTGCAGCAGGCTCCTGCTC
CTGCCTCTCCTGCTGGCTGTAAGTGGTCTCCGTCCTGTCCAGGCCCAGGC
CCAGAGCGATTGCAGTTGCTCTACGGTGAGCCCGGGCGTGCTGGCAGGGA
TCGTGATGGGAGACCTGGTGCTGACAGTGCTCATTGCCCTGGCCGTGTAC
TTCCTGGGCCGGCTGGTCCCTCGGGGGCGAGGGGCTGCGGAGGCAGCGAC
CCGGAAACAGCGTATCACTGAGACCGAGTCGCCTTATCAGGAGCTCCAGG
GTCAGAGGTCGGATGTCTACAGCGACCTCAACACACAGAGGCCGTATTAC
AAAgTCGAGGGCGGCGGAGAGGGCAGAGGAAGTCTTCTAACATGCGGTGA
CGTGGAGGAGAATCCCGGCCCTAGGatggccttaccagtgaccgccttgc
tcctgcgctggccttgctgctccacgccgccaggcgggatcccaggta
caactgcagcagtctgggcctgagctggagaagcctggcgcttcagtgaa
gatatcctgcaaggcttctggttactcattcactggctacaccatgaact
gggtgaagcagagccatggaaagagccttgagtggattggacttattact
ccttacaatggtgcttctagctacaaccagaagttcaggggcaaggccac
attaactgtagacaagtcatccagcacagcctacatggacctcctcagtc
tgacatctgaagactctgcagtctatttctgtgcaaggggggggttacgac
gggaggggttttgactactggggccaagggaccacggtcaccgtctcctc
aggtggaggcggttcaggcggcggtggctctagcggtggtggatcggaca
tcgagctcactcagtctccagcaatcatgtctgcatctccaggggagaag
gtcaccatgacctgcagtgccagctcaagtgtaagttacatgcactggta
ccagcagaagtcaggcacctcccccaaaagatggatttatgacacatcca
aactggcttctggagtcccaggtcgcttcagtggcagtgggtctggaaac
tcttactctctcacaatcagcagcgtggaggctgaagatgatgcaactta
ttactgccagcagtggagtaagcaccctctcacgtacggtgctgggacaa
agttggaaatcaaagctagcggtggcggaggttctggaggtgggggttcc
tcacccactgaaccaagctccaaaaccggtaaccccagacacctgcatgt
tctgattgggacctcagtggtcaaaatccctttcaccatcctcctcttct
ttctccttcatcgctggtgctccaacaaaaaaatgctgctgtaatggac
caagagcctgcagggaacagaacagtgaacagcgaggattctgatgaaca
agaccatcaggaggtgtcatacgcataaGtcgacaatcaacctctggatt
acaaaatttgtgaaagattgactggtattcttaactatgttgctccttt
acgctatgtggatacgctgctttaatgcctttgtatcatgctattgcttc
ccgtatggctttcattttctcctccttgtataaatcctggttgctgtctc
tttatgaggagttgtggcccgttgtcaggcaacgtggcgtggtgtgcact
gtgtttgctgacgcaacccccactggttggggcattgccaccacctgtca
gctcctttccgggactttcgctttccccctccctattgccacggcggaac

```
tcatcgccgctgccttgcccgctgctggacaggggctcggctgttgggc
actgacaattccgtggtgttgtcggggaagctgacgtccttttccatggct
gctcgcctgtgttgccacctggattctgcgcgggacgtccttctgctacg
tcccttcggccctcaatccagcggaccttcctcccgcgcctgctgccg
gctctgcggcctcttccgcgtcttcgccttcgccctcagacgagtcggat
ctcccctttgggccgcctccccgcctggaattcgagctcggtacctttaag
accaatgacttacaaggcagctgtagatcttagccactttttaaaagaaa
agggggactggaagggctaattcactcccaacgaagacaagatctgctt
tttgcttgtactgggtctctctggttagaccagatctgagcctgggagct
ctctggctaactagggaacccactgcttaagcctcaataaagcttgcctt
gagtgcttcaagtagtgtgtgcccgtctgttgtgtgactctggtaactag
agatccctcagaccttttagtcagtgtggaaaatctctagcagtagtag
ttcatgtcatcttattattcagtatttataacttgcaaagaaatgaatat
cagagagtgagaggaacttgtttattgcagcttataatggttacaaataa
agcaatagcatcacaaatttcacaaataaagcattttttttcactgcattc
tagttgtggtttgtccaaactcatcaatgtatcttatcatgtctggctct
agctatcccgccctaactccgcccagttccgcccattctccgcccatg
gctgactaatttttttatttatgcagaggccgaggccgcctcggcctct
gagctattccagaagtagtgaggaggcttttttggaggcctacgcttttg
cgtcgagacgtacccaattcgccctatagtgagtcgtattacgcgcgctc
actggccgtcgttttacaacgtcgtgactgggaaaaccctggcgttaccc
aacttaatcgccttgcagcacatccccctttcgccagctggcgtaatagc
gaagaggcccgcaccgatcgccctcccaacagttgcgcagcctgaatgg
cgaatggcgcgacgcgccctgtagcggcgcattaagcgcggcgggtgtgg
tggttacgcgcagcgtgaccgctacacttgccagcgccctagcgcccgct
cctttcgctttcttcccttcctttctcgccacgttcgccggctttccccg
tcaagctctaaatcgggggctccctttagggttccgatttagtgctttac
ggcacctcgaccccaaaaaacttgattagggtgatggttcacgtagtggg
ccatcgccctgatagacggtttttcgccctttgacgttggagtccacgtt
ctttaatagtggactcttgttccaaactggaacaacactcaaccctatct
cggtctattcttttgatttataaggattttgccgatttcggcctattgg
ttaaaaaatgagctgatttaacaaaaatttaacgcgaattttaacaaaat
attaacgtttacaatttcccaggtggcacttttcggggaaatgtgcgcgg
aacccctatttgtttatttttctaaatacattcaaatatgtatccgctca
tgagacaataaccctgataaatgcttcaataatattgaaaaaggaagagt
atgagtattcaacat -continued ctatgaccatgattacgccaagcgcgcaattaaccctcactaaagggaac aaaagctggagctgcaagcttaatgtagtcttatgcaatactcttgtagt cttgcaacatggtaacgatgagttagcaacatgccttacaaggagagaaa aagcaccgtgcatgccgattggtggaagtaaggtggtacgatcgtgcctt attaggaaggcaacagacgggtctgacatggattggacgaaccactgaat tgccgcattgcagagatattgtatttaagtgcctagctcgatacaataaa cgggtctctctggttagaccagatctgagcctgggagctctctggctaac tagggaacccactgcttaagcctcaataaagcttgccttgagtgcttcaa gtagtgtgtgcccgtctgttgtgtgactctggtaactagagatccctcag acccttttagtcagtgtggaaaatctctagcagtggcgcccgaacaggga cctgaaagcgaaagggaaaccagagctctctcgacgcaggactcggcttg ctgaagcgcgcacggcaagaggcgaggggcggcgactggtgagtacgcca aaaattttgactagcggaggctagaaggagagagatgggtgcgagagcgt cagtattaagcgggggagaattagatcgcgatgggaaaaaattcggttaa ggccaggggaaagaaaaaatataaattaaaacatatagtatgggcaagc agggagctagaacgattcgcagttaatcctggcctgttagaaacatcaga aggctgtagacaaatactgggacagctacaaccatcccttcagacaggat cagaagaacttagatcattatataatacagtagcaaccctctattgtgtg catcaaaggatagagataaaagacaccaaggaagctttagacaagataga ggaagagcaaaacaaaagtaagaccaccgcacagcaagcggccgctgatc ttcagacctggaggaggagatatgagggacaattggagaagtgaattata taaatataaagtagtaaaaattgaaccattaggagtagcacccaccaagg caaagagaagagtggtgcagagagaaaaaagagcagtgggaataggagct ttgttccttgggttcttgggagcagcaggaagcactatgggcgcagcctc aatgacgctgacggtacaggccagacaattattgtctggtatagtgcagc agcagaacaatttgctgagggctattgaggcgcaacagcatctgttgcaa ctcacagtctggggcatcaagcagctccaggcaagaatcctggctgtgga aagatacctaaaggatcaacagctcctggggatttggggttgctctggaa aactcatttgcaccactgctgtgccttggaatgctagttggagtaataaa tctctggaacagattggaatcacacgacctggatggagtgggacagagaa attaacaattacacaagcttaatacactccttaattgaagaatcgcaaaa ccagcaagaaaagaatgaacaagaattattggaattagataaatgggcaa gtttgtggaattggtttaacataacaaattggctgtggtatataaaatta ttcataatgatagtaggaggcttggtaggtttaagaatagttttgctgt actttctatagtgaatagagttaggcagggatattcaccattatcgtttc agacccacctcccaaccccgaggggacccgacaggcccgaaggaatagaa gaagaaggtggagagagagacagagacagatccattcgattagtgaacgg atctcgacggtatcgattagactgtagcccaggaatatggcagctagatt gtacacatttagaaggaaaagttatcttggtagcagttcatgtagccagt ggatatatagaagcagaagtaattccagcagagacagggcaagaaacagc -continued atacttcctcttaaaattagcaggaagatggccagtaaaaacagtacata cagacaatggcagcaatttccaccagtactacagttaaggccgcctgttgg tgggcggggatcaagcaggaatttggcattccctacaatccccaaagtca aggagtaatagaatctatgaataaagaattaaagaaaattataggacagg taagagatcaggctgaacatcttaagacagcagtacaaatggcagtattc atccacaattttaaaagaaaaggggggattgggggtacagtgcaggga aagaatagtagacataatagcaacagacatacaaactaaagaattacaaa aacaaattacaaaaattcaaaattttcgggtttattacagggacagcaga gatccagtttggctgcatacgcgtcgtgaggctccggtgcccgtcagtgg gcagagcgcacatcgcccacagtccccgagaagttgggggggagggtcgg caattgaaccggtgcctagagaaggtggcgcggggtaaactgggaaagtg atgtcgtgtactggctccgccttttttcccgagggtgggggagaaccgtat ataagtgcagtagtcgccgtgaacgttctttttcgcaacgggtttgccgc cagaacacaggtaagtgccgtgtgtggttcccgcgggcctggcctctttta cgggttatggcccttgcgtgccttgaattacttccacctggctgcagtac gtgattcttgatcccgagcttcggggttggaagtgggtgggagagttcgag gccttgcgcttaaggagcccccttcgcctcgtgcttgagttgaggcctggc ctgggcgctggggccgccgcgtgcgaatctggtggccacttcgcgcctgt ctcgctgctttcgataagtctctagccatttaaaattttttgatgacctgc tgcgacgctttttttctggcaagatagtcttgtaaatgcgggccaagatc tgcacactggtatttcggttttttggggccgcggggcggcgacggggcccgt gcgtcccagcgcacatgttcggcgaggcggggcctgcgagcgcggccacc gagaatcggacgggggtagtctcaagctggccggcctgctctggtgcctg gcctcgcgccgccgtgtatcgccccgccctgggcggcaaggctggcccgg tcggcaccagttgcgtgagcggaaagatggccgcttcccggccctgctgc agggagctcaaaatggaggacgcggcgctcgggagagcgggcgggtgagt cacccacacaaaggaaaagggccttccgtcctcagccgtcgcttcatgt gactccacggagtaccgggcgccgtccaggcacctcgattagttctcgtg cttttggagtacgtcgtcttttaggttgggggggagggggttttatgcgatgg agtttccccacactgagtgggtggagactgaagttaggccagcttggcac ttgatgtaattctccttggaatttgccctttttgagtttggatcttggtt cattctcaagcctcagacagtggttcaaagttttttttcttccatttcag gtgtcgtgagctagaATGGGGGGACTTGAACCCTGCAGCAGGCTCCTGCT

CCTGCCTCTCCTGCTGGCTGTAAGTGGTCTCCGTCCTGTCCAGGCCCAGG

CCCAGAGCGATTGCAGTTGCTCTACGGTGAGCCCGGGCGTGCTGGCAGGG

ATCGTGATGGGAGACCTGGTGCTGACAGTGCTCATTGCCCTGGCCGTGTA

CTTCCTGGGCCGGCTGGTCCCTCGGGGGCGAGGGGCTGCGGAGGCAGCGA

CCCGGAAACAGCGTATCACTGAGACCGAGTCGCCTTATCAGGAGCTCCAG

GGTCAGAGGTCGGATGTCTACAGCGACCTCAACACACAGAGGCCGTATTA

CAAAgTCGAGGGCGGCGGAGAGGGCAGAGGAAGTCTTCTAACATGCGGTG

ACGTGGAGGAGAATCCCGGCCCTAGGatggccttaccagtgaccgccttg

-continued ctcctgccgctggccttgctgctccacgccgccaggccgggatcccaggt
acaactgcagcagtctgggcctgagctggagaagcctggcgcttcagtga
agatatcctgcaaggcttctggttactcattcactggctacaccatgaac
tgggtgaagcagagccatgaaagagccttgagtggattggacttattac
tccttacaatggtgcttctagctacaaccagaagttcaggggcaaggcca
cattaactgtagacaagtcatccagcacagcctacatggacctcctcagt
ctgacatctgaagactctgcagtctatttctgtgcaaggggggttacga
cgggaggggttttgactactggggccaagggaccacggtcaccgtctcct
caggtggaggcggttcaggcggcggtggctctagcggtggtggatcggac
atcgagctcactcagtctccagcaatcatgtctgcatctccaggggagaa
ggtcaccatgacctgcagtgccagctcaagtgtaagttacatgcactggt
accagcagaagtcaggcacctcccccaaaagatggatttatgacacatcc
aaactggcttctggagtcccaggtcgcttcagtggcagtgggtctggaaa
ctcttactctctcacaatcagcagcgtggaggctgaagatgatgcaactt
attactgccagcagtggagtaagcaccctctcacgtacggtgctgggaca
aagttggaaatcaaagcTAGCggtggcggaggttctggaggtgggggttc
cCAGGGGGCCTGGCCACATGAGGGAGTCCACAGAAAACCTTCCCTCCTGG
CCCACCCAGGTCCCCTGGTGAAATCAGAAGAGACAGTCATCCTGCAATGT
TGGTCAGATGTCAGGTTTCAGCACTTCCTTCTGCACAGAGAAGGGAAGTT
TAAGGACACTTTGCACCTCATTGGAGAGCACCATGATGGGGTCTCCAAGG
CCAACTTCTCCATCGGTCCCATGATGCAAGACCTTGCAGGGACCTACAGA
TGCTACGGTTCTGTTACTCACTCCCCCTATCAGTTGTCAGCTCCCAGTGA
CCCTCTGGACATCGTCATCACAGGTCTATATGAGAAACCTTCTCTCTCAG
CCCAGCCGGGCCCCACGGTTCTGGCAGGAGAGCGTGACCTTGTCCTGC
AGCTCCCGGAGCTCCTATGACATGTACCATCTATCCAGGGAGGGGGAGGC
CCATGAACGTAGGTTCTCTGCAGGGCCCAAGGTCAACGGAACATTCCAGG
CCGACTTTCCTCTGGGCCCTGCCACCCACGGAGGAACCTACAGATGCTTC
GGCTCTTTCCGTGACTCTCCATACGAGTGGTCAAACTCGAGTGACCCACT
GCTTGTTTCTGTCACAGGAAACCCTTCAAATAGTTGGCTTTCACCCACTG
AACCAAGCTCCGAAACCGGTAACCCCAGACACCTGCATGTTCTGATTGGG
ACCTCAGTGGTCATCATCCTCTTCATCCTCCTCCTCTTCTTTCTCCTTCA
TCGCTGGTGCTGCAACAAAAAAATGCTGTTGTAATGGACCAAGAGCCTG
CAGGGAACAGAACAGTGAACAGGGAGGACTCTGATGAACAAGACCCTCAG
GAGGTGACATATGCACAGTTGAATCACTGCGTTTTCACACAGAGAAAAAT
CACTCACCCTTCTCAGAGGCCAAGACACCCCAACAGATATCATCGTGT
ACACGGAACTTCCAAATGCTGAGCCCTGAGtcgacaatcaacctctggat
tacaaaatttgtgaaagattgactggtattcttaactatgttgctccttt
tacgctatgtggatacgctgctttaatgcctttgtatcatgctattgctt
cccgtatggctttcattttctcctccttgtataaatcctggttgctgtct
ctttatgaggagttgtggcccgttgtcaggcaacgtggcgtggtgtgcac tgtgtttgctgacgcaaccccactggttggggcattgccaccacctgtc
agctcctttccggggactttcgctttcccctccctattgccacggcggaa
ctcatcgccgcctgccttgcccgctgctggacaggggctcggctgttggg
cactgacaattccgtggtgttgtcggggaagctgacgtcctttccatggc
tgctcgcctgtgttgccacctggattctgcgcgggacgtccttctgctac
gtcccttcggccctcaatccagcggaccttcttcccgcggcctgctgcc
ggctctgcggcctcttccgcgtcttcgccttcgccctcagacgagtcgga
tctcccttgggccgcctccccgcctggaattcgagctcggtacctttaa
gaccaatgacttacaaggcagctgtagatcttagccacttttttaaaagaa
aaggggggactggaagggctaattcactcccaacgaagacaagatctgct
ttttgcttgtactgggtctctctggttagaccagatctgagcctgggagc
tctctggctaactagggaacccactgcttaagcctcaataaagcttgcct
tgagtgcttcaagtagtgtgtgcccgtctgttgtgtgactctggtaacta
gagatccctcagaccctttagtcagtgtggaaaatctctagcagtagta
gttcatgtcatcttattattcagtatttataacttgcaaagaaatgaata
tcagagagtgagaggaacttgtttattgcagcttataatggttacaaata
aagcaatagcatcacaaatttcacaaataaagcatttttttcactgcatt
ctagttgtggtttgtccaaactcatcaatgtatcttatcatgtctggctc
tagctatcccgcccctaactccgcccagttccgcccattctccgccccat
ggctgactaattttttttatttatgcagaggccgaggccgcctcggcctc
tgagctattccagaagtagtgaggaggctttttttggaggcctacgcttt
gcgtcgagacgtacccaattcgccctatagtgagtcgtattacgcgcgct
cactggccgtcgttttacaacgtcgtgactgggaaaaccctggcgttacc
caacttaatcgccttgcagcacatccccctttcgccagctggcgtaatag
cgaagaggcccgcaccgatcgcccttcccaacagttgcgcagcctgaatg
gcgaatggcgcgacgcgccctgtagcggcgcattaagcgcggcgggtgtg
gtggttacgcgcagcgtgaccgctacacttgccagcgccctagcgcccgc
tcctttcgctttcttcccttcctttctcgccacgttcgccggctttcccc
gtcaagctctaaatcggggggctccctttagggttccgatttagtgcttta
cggcacctcgaccccaaaaaacttgattagggtgatggttcacgtagtgg
gccatcgccctgatagacggtttttcgccctttgacgttggagtccacgt
tctttaatagtggactcttgttccaaactggaacaacactcaaccctatc
tcggtctattcttttgatttataagggattttgccgatttcggcctattg
gttaaaaaatgagctgatttaacaaaaatttaacgcgaattttaacaaaa
tattaacgtttacaatttcccaggtggcacttttcggggaaatgtgcgcg
gaacccctatttgtttatttttctaaatacattcaaatatgtatccgctc
atgagacaataaccctgataaatgcttcaataatattgaaaaaggaagag
tatgagtattcaacatttccgtgtcgcccttattcccttttttgcggcat
tttgccttcctgttttgctcacccagaaacgctggtgaaagtaaaagat
gctgaagatcagttgg The nucleic acid sequence of a KIR-CAR comprising an antigen binding domain that binds to CD19 and a cytoplasmic domain comprising a KIR2DS2 domain is provided below.

```
CD19 KIR2DS2 construct sequence
                                    (SEQ ID NO: 330)
gtgcacgagtgggttacatcgaactggatctcaacagcggtaagatcctt gagagttttcgccccgaagaacgttttccaatgatgagcacttttaaagt tctgctatgtggcgcggtattatcccgtattgacgccgggcaagagcaac tcggtcgccgcatacactattctcagaatgacttggttgagtactcacca gtcacagaaaagcatcttacggatggcatgacagtaagagaattatgcag tgctgccataaccatgagtgataacactgcggccaacttacttctgacaa cgatcggaggaccgaaggagctaaccgcttttttgcacaacatgggggat catgtaactcgccttgatcgttgggaaccggagctgaatgaagccatacc aaacgacgagcgtgacaccacgatgcctgtagcaatggcaacaacgttgc gcaaactattaactggcgaactacttactctagcttcccggcaacaatta atagactggatggaggcggataaagttgcaggaccacttctgcgctcggc ccttccggctggctggtttattgctgataaatctggagccggtgagcgtg ggtctcgcggtatcattgcagcactggggccagatggtaagcctcccgt atcgtagttatctacacgacggggagtcaggcaactatggatgaacgaaa tagacagatcgctgagataggtgcctcactgattaagcattggtaactgt cagaccaagtttactcatatatactttagattgatttaaaacttcattt taatttaaaaggatctaggtgaagatcctttttgataatctcatgaccaa aatcccttaacgtgagttttcgttccactgagcgtcagacccgctagaaa agatcaaaggatcttcttgagatcctttttttctgcgcgtaatctgctgc ttgcaaacaaaaaaccaccgctaccagcggtggtttgtttgccggatca agagctaccaactctttttccgaaggtaactggcttcagcagagcgcaga taccaaatactgtccttctagtgtagccgtagttaggccaccacttcaag aactctgtagcaccgcctacatacctcgctctgctaatcctgttaccagt ggctgctgccagtggcgataagtcgtgtcttaccgggttggactcaagac gatagttaccggataaggcgcagcggtcgggctgaacggggggttcgtgc acacagcccagcttggagcgaacgacctacaccgaactgagatacctaca gcgtgagctatgagaaagcgccacgcttcccgaagggagaaaggcggaca ggtatccggtaagcggcagggtcggaacaggagagcgcacgagggagctt ccaggggggaaacgcctggtatctttatagtcctgtcgggtttcgccacct ctgacttgagcgtcgatttttgtgatgctcgtcaggggggcggagcctat ggaaaaacgccagcaacgcggcctttttacggttcctggccttttgctgg ccttttgctcacatgttctttcctgcgttatcccctgattctgtggataa ccgtattaccgcctttgagtgagctgataccgctcgccgcagccgaacga ccgagcgcagcgagtcagtgagcgaggaagcggaagagcgcccaatacgc aaaccgcctctccccgcgcgttggccgattcattaatgcagctggcacga caggtttcccgactggaaagcgggcagtgagcgcaacgcaattaatgtga gttagctcactcattaggcaccccaggctttacactttatgcttccggct
```

```
cgtatgttgtgtggaattgtgagcggataacaatttcacacaggaaacag ctatgaccatgattacgccaagcgcgcaattaaccctcactaaagggaac aaaagctggagctgcaagcttaatgtagtcttatgcaatactcttgtagt cttgcaacatggtaacgatgagttagcaacatgccttacaaggagagaaa aagcaccgtgcatgccgattggtggaagtaaggtggtacgatcgtgcctt attaggaaggcaacagacgggtctgacatggattggacgaaccactgaat tgccgcattgcagagatattgtatttaagtgcctagctcgatacaataaa cgggtctctctggttagaccagatctgagcctgggagctctctggctaac tagggaacccactgcttaagcctcaataaagcttgccttgagtgcttcaa gtagtgtgtgcccgtctgttgtgtgactctggtaactagagatccctcag acccttttagtcagtgtggaaaatctctagcagtggcgcccgaacaggga cctgaaagcgaaagggaaaccagagctctctcgacgcaggactcggcttg ctgaagcgcgcacggcaagaggcgaggggcggcgactggtgagtacgcca aaaattttgactagcggaggctagaaggagagagatgggtgcgagagcgt cagtattaagcgggggagaattagatcgcgatgggaaaaaattcggttaa ggccagggggaaagaaaaaatataaattaaaacatatagtatgggcaagc agggagctagaacgattcgcagttaatcctggcctgttagaaacatcaga aggctgtagacaaatactgggacagctacaaccatcccttcagacaggat cagaagaacttagatcattatataatacagtagcaaccctctattgtgtg catcaaaggatagagataaaagacaccaaggaagctttagacaagataga ggaagagcaaaacaaaagtaagaccaccgcacagcaagcggccgctgatc ttcagacctggaggaggagatatgagggacaattggagaagtgaattata taaatataaagtagtaaaaattgaaccattaggagtagcacccaccaagg caaagagaagagtggtgcagagagaaaaaagagcagtgggaataggagct ttgttccttgggttcttgggagcagcaggaagcactatgggcgcagcctc aatgacgctgacggtacaggccagacaattattgtctggtatagtgcagc agcagaacaatttgctgagggctattgaggcgcaacagcatctgttgcaa ctcacagtctggggcatcaagcagctccaggcaagaatcctggctgtgga aagatacctaaaggatcaacagctcctggggatttggggttgctctggaa aactcatttgcaccactgctgtgccttggaatgctagttggagtaataaa tctctggaacagattggaatcacacgacctggatggagtgggacagagaa attaacaattacacaagcttaatacactccttaattgaagaatcgcaaaa ccagcaagaaaagaatgaacaagaattattggaattagataaatgggcaa gtttgtggaattggtttaacataacaaattggctgtggtatataaaatta ttcataatgatagtaggaggcttggtaggtttaagaatagttttgctgt actttctatagtgaatagagttaggcagggatattcaccattatcgtttc agacccacctcccaaccccgaggggacccgacaggcccgaaggaatagaa gaagaaggtggagagagagacagagacagatccattcgattagtgaacgg atctcgacggtatcgattagactgtagcccaggaatatggcagctagatt gtacacatttagaaggaaaagttatcttggtagcagttcatgtagccagt
```

-continued

```
ggatatatagaagcagaagtaattccagcagagacagggcaagaaacagc
atacttcctcttaaaattagcaggaagatggccagtaaaaacagtacata
cagacaatggcagcaatttcaccagtactacagttaaggccgcctgttgg
tgggcggggatcaagcaggaatttggcattccctacaatccccaaagtca
aggagtaatagaatctatgaataaagaattaaagaaaattataggacagg
taagagatcaggctgaacatcttaagacagcagtacaaatggcagtattc
atccacaattttaaaagaaaagggggggattggggggtacagtgcagggga
aagaatagtagacataatagcaacagacatacaaactaaagaattacaaa
aacaaattacaaaaattcaaaattttcgggtttattacagggacagcaga
gatccagtttggctgcatacgcgtcgtgaggctccggtgccgtcagtgg
gcagagcgcacatcgcccacagtccccgagaagttggggggaggggtcgg
caattgaaccggtgcctagagaaggtggcgcggggtaaactgggaaagtg
atgtcgtgtactggctccgccttttcccgagggtgggggagaaccgtat
ataagtgcagtagtcgccgtgaacgttcttttcgcaacgggtttgccgc
cagaacacaggtaagtgccgtgtgtggttcccgcgggcctggcctcttta
cgggttatggcccttgcgtgccttgaattacttccacctggctgcagtac
gtgattcttgatcccgagcttcgggttggaagtgggtgggagagttcgag
gccttgcgcttaaggagccccttcgcctcgtgcttgagttgaggcctggc
ctgggcgctgggccgccgcgtgcgaatctggtggcaccttcgcgcctgt
ctcgctgctttcgataagtctctagccatttaaaatttttgatgacctgc
tgcgacgcttttttctggcaagatagtcttgtaaatgcgggccaagatc
tgcacactggtatttcggttttggggccgcgggcggcgacggggcccgt
gcgtcccagcgcacatgttcggcgaggcggggcctgcgagcgcggccacc
gagaatcggacgggggtagtctcaagctggccggcctgctctggtgcctg
gcctcgcgccgcgtgtatcgcccgccctgggcggcaaggctggccgg
tcggcaccagttgcgtgagcggaaagatggccgcttccggccctgctgc
agggagctcaaaatggaggacgcggcgctcgggagagcgggcgggtgagt
cacccacacaaaggaaaagggcctttccgtcctcagccgtcgcttcatgt
gactccacggagtaccgggcgccgtccaggcacctcgattagttctcgtg
cttttggagtacgtcgtctttaggtggggggaggggttttatgcgatgg
agtttccccacactgagtgggtggagactgaagttaggccagcttggcac
ttgatgtaattctccttggaatttgcccttttttgagtttggatcttggtt
cattctcaagcctcagacagtggttcaaagttttttttcttccatttcagg
tgtcgtgagctagaATGGGGGGACTTGAACCCTGCAGCAGGCTCCTGCTC
CTGCCTCTCCTGCTGGCTGTAAGTGGTCTCCGTCCTGTCCAGGCCCAGGC
CCAGAGCGATTGCAGTTGCTCTACGGTGAGCCCGGGCGTGCTGGCAGGGA
TCGTGATGGAGACCTGGTGCTGACAGTGCTCATTGCCCTGGCCGTGTAC
TTCCTGGGCCGGCTGGTCCCTCGGGGGCGAGGGGCTGCGGAGGCAGCGAC
CCGGAAACAGCGTATCACTGAGACCGAGTCGCCTTATCAGGAGCTCCAGG
GTCAGAGGTCGGATGTCTACAGCGACCTCAACACACAGAGGCCGTATTAC
AAAgTCGAGGGCGGCGGAGAGGGCAGAGGAAGTCTTCTAACATGCGGTGA
```

-continued

```
CGTGGAGGAGAATCCCGGCCCTAGGatggccttaccagtgaccgccttgc
tcctgccgctggccttgctgctccacgccgccaggccgggatccGACATC
CAGATGACACAGACTACATCCTCCCTGTCTGCCTCTCTGGGAGACAGAGT
CACCATCAGTTGCAGGGCAAGTCAGGACATTAGTAAATATTTAAATTGGT
ATCAGCAGAAACCAGATGGAACTGTTAAACTCCTGATCTACCATACATCA
AGATTACACTCAGGAGTCCCATCAAGGTTCAGTGGCAGTGGGTCTGGAAC
AGATTATTCTCTCACCATTAGCAACCTGGAGCAAGAAGATATTGCCACTT
ACTTTTGCCAACAGGGTAATACGCTTCCGTACACGTTCGGAGGGGGGACT
AAGTTGGAAATAACAGGTGGCGGTGGCTCGGGCGGTGGTGGGTCGGGTGG
CGGCGGATCTGAGGTGAAACTGCAGGAGTCAGGACCTGGCCTGGTGGCGC
CCTCACAGAGCCTGTCCGTCACATGCACTGTCTCAGGGGTCTCATTACCC
GACTATGGTGTAAGCTGGATTCGCCAGCCTCCACGAAAGGGTCTGGAGTG
GCTGGGAGTAATATGGGGTAGTGAAACCACATACTATAATTCAGCTCTCA
AATCCAGACTGACCATCATCAAGGACAACTCCAAGAGCCAAGTTTTCTTA
AAAATGAACAGTCTGCAAACTGATGACACAGCCATTTACTACTGTGCCAA
ACATTATTACTACGGTGGTAGCTATGCTATGGACTACTGGGGTCAAGGAA
CCTCAGTCACCGTCTCCTCAgctagcACGCGTggtggcggaggttctgga
ggtgggggttcccaggggcctggccacatgagggagtccacagaaaacc
ttccctcctggcccacccaggtccctggtgaaatcagaagagacagtca
tcctgcaatgttggtcagatgtcaggtttgagcacttccttctgcacaga
gaggggaagtataaggacactttgcacctcattggagagcaccatgatgg
ggtctccaaggccaacttctccatcggtcccatgatgcaagaccttgcag
ggacctacagatgctacggttctgttactcactcccccctatcagttgtca
gctcccagtgaccctctggacatcgtcatcacaggtctatatgagaaacc
ttctctctcagcccagccgggccccacggttttggcaggagagagcgtga
ccttgtcctgcagctcccggagctcctatgacatgtaccatctatccagg
gaggggaggcccatgaacgtaggttctctgcagggcccaaggtcaacgg
aacattccaggccgactttcctctgggccctgccacccacggaggaacct
acagatgcttcggctcttccgtgactctccctatgagtggtcaaactcg
agtgaccccactgcttgtttctgtcacaggaaacccttcaaatagttggcc
ttcacccactgaaccaagctccaaaaccggtaaccccagacacctgcatg
ttctgattgggacctcagtggtcaaaatccctttcaccatcctcctcttc
ttttctccttcatcgctggtgctccaacaaaaaaaatgctgctgtaatgga
ccaagagcctgcagggaacagaacagtgaacagcgaggattctgatgaac
aagaccatcaggaggtgtcatacgcataaGtcgacaatcaacctctggat
tacaaaatttgtgaaagattgactggtattcttaactatgttgctccttt
tacgctatgtggatacgctgctttaatgcctttgtatcatgctattgctt
cccgtatggctttcattttctcctccttgtataaatcctggttgctgtct
ctttatgaggagttgtggcccgttgtcaggcaacgtggcgtggtgtgcac
tgtgtttgctgacgcaaccccactggttggggcattgccaccacctgtc
```

```
agctcctttccgggactttcgctttcccctccctattgccacggcggaa
ctcatcgccgcctgccttgccgctgctggacaggggctcggctgttggg
cactgacaattccgtggtgttgtcggggaagctgacgtcctttccatggc
tgctcgcctgtgttgccacctggattctgcgcgggacgtccttctgctac
gtcccttcggccctcaatccagcggaccttccttcccgcggcctgctgcc
ggctctgcggcctcttccgcgtcttcgccttcgcctcagacgagtcgga
tctcccttgggccgcctcccgcctggaattcgagctcggtacctttaa
gaccaatgacttacaaggcagctgtagatcttagccactttttaaaagaa
aaggggggactggaagggctaattcactcccaacgaagacaagatctgct
ttttgcttgtactgggtctctctggttagaccagatctgagcctgggagc
tctctggctaactagggaacccactgcttaagcctcaataaagcttgcct
tgagtgcttcaagtagtgtgtgcccgtctgttgtgtgactctggtaacta
gagatccctcagacccttttagtcagtgtggaaaatctctagcagtagta
gttcatgtcatcttattattcagtatttataacttgcaaagaaatgaata
tcagagagtgagaggaacttgtttattgcagcttataatggttacaaata
aagcaatagcatcacaaatttcacaaataaagcatttttttcactgcatt
ctagttgtggtttgtccaaactcatcaatgtatcttatcatgtctggctc
tagctatcccgcccctaactccgcccagttccgcccattctccgcccat
ggctgactaatttttttatttatgcagaggccgaggccgcctcggcctc
tgagctattccagaagtagtgaggaggcttttttggaggcctacgctttt
gcgtcgagacgtacccaattcgccctatagtgagtcgtattacgcgcgct
cactggccgtcgttttacaacgtcgtgactgggaaaaccctggcgttacc
caacttaatcgccttgcagcacatccccctttcgccagctggcgtaatag
cgaagaggcccgcaccgatcgcccttcccaacagttgcgcagcctgaatg
gcgaatggcgcgacgcgcctgtagcggcgcattaagcgcggcgggtgtg
gtggttacgcgcagcgtgaccgctacacttgccagcgccctagcgcccgc
tcctttcgctttcttcccttcctttctcgccacgttcgccggctttcccc
gtcaagctctaaatcggggggctccctttagggttccgatttagtgcttta
cggcacctcgaccccaaaaaacttgattagggtgatggttcacgtagtgg
gccatcgccctgatagacggtttttcgccctttgacgttggagtccacgt
tctttaatagtggactcttgttccaaactggaacaacactcaaccctatc
tcggtctattcttttgatttataagggattttgccgatttcggcctattg
gttaaaaaatgagctgatttaacaaaaatttaacgcgaattttaacaaaa
tattaacgtttacaatttcccaggtggcacttttcggggaaatgtgcgcg
gaacccctatttgtttatttttctaaatacattcaaatatgtatccgctc
atgagacaataaccctgataaatgcttcaataatattgaaaaaggaagag
tatgagtattcaacatttccgtgtcgcccttattccttttttgcggcat
tttgccttcctgtttttgctcacccagaaacgctggtgaaagtaaaagat
gctgaagatcagttgg
```

The nucleic acid sequence of an inhibitory CAR comprising an antigen binding domain that binds to CD19 and a cytoplasmic domain comprising a PD1 domain is provided below.

CD19-PD1 chimeric CAR sequence
(SEQ ID NO: 331)
```
TGATGCGGTATTTTCTCCTTACGCATCTGTGCGGTATTTCACACCGCATA
TGGTGCACTCTCAGTACAATCTGCTCTGATGCCGCATAGTTAAGCCAGCC
CCGACACCCGCCAACACCCGCTGACGCGCCCTGACGGGCTTGTCTGCTCC
CGGCATCCGCTTACAGACAAGCTGTGACCGTCTCCGGGAGCTGCATGTGT
CAGAGGTTTTCACCGTCATCACCGAAACGCGCGAGACGAAAGGGCCTCGT
GATACGCCTATTTTTATAGGTTAATGTCATGATAATAATGGTTTCTTAGA
CGTCAGGTGGCACTTTTCGGGGAAATGTGCGCGGAACCCCTATTTGTTTA
TTTTTCTAAATACATTCAAATATGTATCCGCTCATGAGACAATAACCCTG
ATAAATGCTTCAATAATATTGAAAAAGGAAGAGTATGAGTATTCAACATT
TCCGTGTCGCCCTTATTCCCTTTTTTGCGGCATTTTGCCTTCCTGTTTTT
GCTCACCCAGAAACGCTGGTGAAAGTAAAAGATGCTGAAGATCAGTTGGG
TGCACGAGTGGGTTACATCGAACTGGATCTCAACAGCGGTAAGATCCTTG
AGAGTTTTCGCCCCGAAGAACGTTTTCCAATGATGAGCACTTTTAAAGTT
CTGCTATGTGGCGCGGTATTATCCCGTATTGACGCCGGGCAAGAGCAACT
CGGTCGCCGCATACACTATTCTCAGAATGACTTGGTTGAGTACTCACCAG
TCACAGAAAAGCATCTTACGGATGGCATGACAGTAAGAGAATTATGCAGT
GCTGCCATAACCATGAGTGATAACACTGCGGCCAACTTACTTCTGACAAC
GATCGGAGGACCGAAGGAGCTAACCGCTTTTTTGCACAACATGGGGGATC
ATGTAACTCGCCTTGATCGTTGGGAACCGGAGCTGAATGAAGCCATACCA
AACGACGAGCGTGACACCACGATGCCTGTAGCAATGGCAACAACGTTGCG
CAAACTATTAACTGGCGAACTACTTACTCTAGCTTCCCGGCAACAATTAA
TAGACTGGATGGAGGCGGATAAAGTTGCAGGACCACTTCTGCGCTCGGCC
CTTCCGGCTGGCTGGTTTATTGCTGATAAATCTGGAGCCGGTGAGCGTGG
GTCTCGCGGTATCATTGCAGCACTGGGGCCAGATGGTAAGCCCTCCCGTA
TCGTAGTTATCTACACGACGGGGAGTCAGGCAACTATGGATGAACGAAAT
AGACAGATCGCTGAGATAGGTGCCTCACTGATTAAGCATTGGTAACTGTC
AGACCAAGTTTACTCATATATACTTTAGATTGATTTAAAACTTCATTTTT
AATTTAAAAGGATCTAGGTGAAGATCCTTTTTGATAATCTCATGACCAAA
ATCCCTTAACGTGAGTTTTCGTTCCACTGAGCGTCAGACCCCGTAGAAAA
GATCAAAGGATCTTCTTGAGATCCTTTTTTTCTGCGCGTAATCTGCTGCT
TGCAAACAAAAAAACCACCGCTACCAGCGGTGGTTTGTTTGCCGGATCAA
GAGCTACCAACTCTTTTTCCGAAGGTAACTGGCTTCAGCAGAGCGCAGAT
ACCAAATACTGTTCTTCTAGTGTAGCCGTAGTTAGGCCACCACTTCAAGA
ACTCTGTAGCACCGCCTACATACCTCGCTCTGCTAATCCTGTTACCAGTG
GCTGCTGCCAGTGGCGATAAGTCGTGTCTTACCGGGTTGGACTCAAGACG
ATAGTTACCGGATAAGGCGCAGCGGTCGGGCTGAACGGGGGGTTCGTGCA
CACAGCCCAGCTTGGAGCGAACGACCTACACCGAACTGAGATACCTACAG
```

```
CGTGAGCTATGAGAAAGCGCCACGCTTCCCGAAGGGAGAAAGGCGGACAG

GTATCCGGTAAGCGGCAGGGTCGGAACAGGAGAGCGCACGAGGGAGCTTC

CAGGGGGAAACGCCTGGTATCTTTATAGTCCTGTCGGGTTTCGCCACCTC

TGACTTGAGCGTCGATTTTTGTGATGCTCGTCAGGGGGCGGAGCCTATG

GAAAAACGCCAGCAACGCGGCCTTTTTACGGTTCCTGGCCTTTTGCTGGC

CTTTTGCTCACATGTTCTTTCCTGCGTTATCCCCTGATTCTGTGGATAAC

CGTATTACCGCCTTTGAGTGAGCTGATACCGCTCGCCGCAGCCGAACGAC

CGAGCGCAGCGAGTCAGTGAGCGAGGAAGCGGAAGAGCGCCCAATACGCA

AACCGCCTCTCCCCGCGCGTTGGCCGATTCATTAATGCAGCTGGCACGAC

AGGTTTCCCGACTGGAAAGCGGGCAGTGAGCGCAACGCAATTAATGTGAG

TTAGCTCACTCATTAGGCACCCCAGGCTTTACACTTTATGCTTCCGGCTC

GTATGTTGTGTGGAATTGTGAGCGGATAACAATTTCACACAGGAAACAGC

TATGACCATGATTACGCCAAGCTCTAATACGACTCACTATAGGGAGACAA

GCTTGCATGCCTGCAGGTCGACATGGCCTTACCAGTGACCGCCTTGCTCC

TGCCGCTGGCCTTGCTGCTCCACGCCGCCAGGCCGGACATCCAGATGACA

CAGACTACATCCTCCCTGTCTGCCTCTCTGGGAGACAGAGTCACCATCAG

TTGCAGGGCAAGTCAGGACATTAGTAAATATTTAAATTGGTATCAGCAGA

AACCAGATGAACTGTTAAACTCCTGATCTACCATACATCAAGATTACAC

TCAGGAGTCCCATCAAGGTTCAGTGGCAGTGGGTCTGGAACAGATTATTC

TCTCACCATTAGCAACCTGGAGCAAGAAGATATTGCCACTTACTTTTGCC

AACAGGGTAATACGCTTCCGTACACGTTCGGAGGGGGGACTAAGTTGGAA

ATAACAGGTGGCGGTGGCTCGGGCGGTGGTGGGTCGGGTGGCGGCGGATC

TGAGGTGAAACTGCAGGAGTCAGGACCTGGCCTGGTGGCGCCCTCACAGA

GCCTGTCCGTCACATGCACTGTCTCAGGGGTCTCATTACCCGACTATGGT

GTAAGCTGGATTCGCCAGCCTCCACGAAAGGGTCTGGAGTGGCTGGGAGT

AATATGGGGTAGTGAAACCACATACTATAATTCAGCTCTCAAATCCAGAC

TGACCATCATCAAGGACAACTCCAAGAGCCAAGTTTTCTTAAAAATGAAC

AGTCTGCAAACTGATGACACAGCCATTTACTACTGTGCCAAACATTATTA

CTACGGTGGTAGCTATGCTATGGACTACTGGGGTCAAGGAACCTCAGTCA

CCGTCTCCTCAgctagcACGCGTggtggcggaggttctggaggtgggggt tccaccctggtggttggtgtcgtgggcggcctgctgggcagcctggtgct gctagtctgggtcctggccgtcatctgctcccgggccgcacgagggacaa taggagccaggcgcaccggccagcccctgaaggaggaccccctcagccgtg cctgtgttctctgtggactatggggagctggatttccagtggcgagagaa gaccccggagcccccgtgccctgtgtccctgagcagacggagtatgcca ccattgtctttcctagcggaatgggcacctcatccccgcccgcaggggc tcagctgacggccctcggagtgcccagccactgaggcctgaggatggaca ctgctcttggccctctgaGGATCCCCGGGTACCGAGCTCGAATTCAAAA

AAAAAAAAAAAAAAAAAAAAAAAAAAAAAAAAAAAAAAAAAAAAAAAAA

AAAAAAAAAACTAGTGGCGCC
```

The present invention also provides nucleic acid molecules and the encoded amino acid sequences comprising a NKR-CAR described herein, e.g., a KIR-CAR, and further comprising an adaptor molecule that interacts with the NKR-CAR to facilitate signal transduction to activate the CAR-expressing cell, e.g., to increase proliferation or cytotoxic activity of the CAR-expressing cell. Any of the antigen binding domains described herein can be substituted for the antigen binding domain in the NKR-CAR constructs provided below.

The nucleic acid sequence of DAP12 is as follows:

```
                                        (SEQ ID NO: 367)
ATGGGGGGACTTGAACCCTGCAGCAGGTTCCTGCTCCTGCCTCTCCTGCT

GGCTGTAAGTGGTCTCCGTCCTGTCCAGGTCCAGGCCCAGAGCGATTGCA

GTTGCTCTACGGTGAGCCCGGGCGTGCTGGCAGGGATCGTGATGGGAGAC

CTGGTGCTGACAGTGCTCATTGCCCTGGCCGTGTACTTCCTGGGCCGGCT

GGTCCCTCGGGGGCGAGGGGCTGCGGAGGCAGCGACCCGGAAACAGCGTA

TCACTGAGACCGAGTCGCCTTATCAGGAGCTCCAGGGTCAGAGGTCGGAT

GTCTACAGCGACCTCAACACACAGAGGCCGTATTACAAATGA
```

The amino acid sequence of DAP12 is as follows:

```
                                        (SEQ ID NO: 368)
MGGLEPCSRFLLLPLLLAVSGLRPVQVQAQSDCSCSTVSPGVLAGIVMGD

LVLTVLIALAVYFLGRLVPRGRGAAEAATRKQRITETESPYQELQGQRSD

VYSDLNTQRPYYK
```

The nucleic acid sequence of FceRg is as follows:

```
                                        (SEQ ID NO: 369)
ATGATTCCAGCAGTGGTCTTGCTCTTACTCCTTTTGGTTGAACAAGCAGC

GGCCCTGGGAGAGCCTCAGCTCTGCTATATCCTGGATGCCATCCTGTTTC

TGTATGGAATTGTCCTCACCCTCCTCTACTGCCGACTGAAGATCCAAGTG

CGAAAGGCAGCTATAACCAGCTATGAGAAATCAGATGGTGTTTACACGGG

CCTGAGCACCAGGAACCAGGAGACTTACGAGACTCTGAAGCATGAGAAAC

CACCACAGTAG
```

The amino acid sequence of FceRg is as follows:

```
                                        (SEQ ID NO: 370)
MIPAVVLLLLLLVEQAAALGEPQLCYILDAILFLYGIVLTLLYCRLKIQV

RKAAITSYEKSDGVYTGLSTRNQETYETLKHEKPPQ
```

Nucleic acid sequences for multi-chain NKR-CARs comprising a NKR-CAR and an adaptor molecule, are also provided herein. In such constructs, the nucleic acid sequence of the NKR-CAR and the adaptor molecule are linked by nucleic acid sequence encoding a peptide cleavage site, e.g., T2A. These nucleic acid molecules are translated as a single chain polypeptide prior to cleavage, and the amino acid sequence of the single chain polypeptide is also provided herein.

The nucleic acid and amino acid sequence of an NKR-CAR comprising an antigen binding domain that binds to mesothelin, e.g., SS1, and a KIRS2 cytoplasmic domain, as well as a DAP12 adaptor molecule linked via the peptide cleavage site T2A is provided below:

DAP12-T2A-SS1-KIRS2 (SEQ ID NO: 332)
1464 bp DNA

| FEATURES | Location |
| --- | --- |
| DAP12 | 1 . . . 339 |
| T2A sequence | 352 . . . 408 |
| SS1-scFv | 481 . . . 1200 |
| GS-linker | 1207 . . . 1236 |
| KIR2DS2-derived sequence | 1237 . . . 1464 |

ATGGGGGGAC TTGAACCCTG CAGCAGGTTC CTGCTCCTGC CTCTCCTGCT GGCTGTAAGT

GGTCTCCGTC CTGTCCAGGT CCAGGCCCAG AGCGATTGCA GTTGCTCTAC GGTGAGCCCG

GGCGTGCTGG CAGGGATCGT GATGGGAGAC CTGGTGCTGA CAGTGCTCAT TGCCCTGGCC

GTGTACTTCC TGGGCCGGCT GGTCCCTCGG GGCGAGGGG CTGCGGAGGC AGCGACCCGG

AAACAGCGTA TCACTGAGAC CGAGTCGCCT TATCAGGAGC TCCAGGGTCA GAGGTCGGAT

GTCTACAGCG ACCTCAACAC ACAGAGGCCG TATTACAAAG TCGAGGGCGG CGGAGAGGGC

AGAGGAAGTC TTCTAACATG CGGTGACGTG GAGGAGAATC CCGGCCCTAG GATGGCCTTA

CCAGTGACCG CCTTGCTCCT GCCGCTGGCC TTGCTGCTCC ACGCCGCCAG GCCGGGATCC

CAGGTACAAC TGCAGCAGTC TGGGCCTGAG CTGGAGAAGC CTGGCGCTTC AGTGAAGATA

TCCTGCAAGG CTTCTGGTTA CTCATTCACT GGCTACACCA TGAACTGGGT GAAGCAGAGC

CATGGAAAGA GCCTTGAGTG GATTGGACTT ATTACTCCTT ACAATGGTGC TTCTAGCTAC

AACCAGAAGT TCAGGGGCAA GGCCACATTA ACTGTAGACA AGTCATCCAG CACAGCCTAC

ATGGACCTCC TCAGTCTGAC ATCTGAAGAC TCTGCAGTCT ATTTCTGTGC AAGGGGGGT

TACGACGGGA GGGGTTTTGA CTACTGGGGC CAAGGGACCA CGGTCACCGT CTCCTCAGGT

GGAGGCGGTT CAGGCGGCGG TGGCTCTAGC GGTGGTGGAT CGGACATCGA GCTCACTCAG

TCTCCAGCAA TCATGTCTGC ATCTCCAGGG GAGAAGGTCA CCATGACCTG CAGTGCCAGC

TCAAGTGTAA GTTACATGCA CTGGTACCAG CAGAAGTCAG GCACCTCCCC CAAAAGATGG

ATTTATGACA CATCCAAACT GGCTTCTGGA GTCCCAGGTC GCTTCAGTGG CAGTGGGTCT

GGAAACTCTT ACTCTCTCAC AATCAGCAGC GTGGAGGCTG AAGATGATGC AACTTATTAC

TGCCAGCAGT GGAGTAAGCA CCCTCTCACG TACGGTGCTG GACAAAGTT GGAAATCAAA

GCTAGCGGTG GCGGAGGTTC TGGAGGTGGG GGTTCCTCAC CCACTGAACC AAGCTCCAAA

ACCGGTAACC CCAGACACCT GCATGTTCTG ATTGGGACCT CAGTGGTCAA ATCCCTTTC

ACCATCCTCC TCTTCTTTCT CCTTCATCGC TGGTGCTCCA ACAAAAAAA TGCTGCTGTA

ATGGACCAAG AGCCTGCAGG GAACAGAACA GTGAACAGCG AGGATTCTGA TGAACAAGAC

CATCAGGAGG TGTCATACGC ATAA

DAP12-T2A-SS1-KIRS2 (SEQ ID NO: 333)
488 aa Protein

| FEATURES | Location |
| --- | --- |
| DAP12 | 1 . . . 113 |
| T2A seq | 118 . . . 136 |
| Signal_peptide from CD8alpha | 138 . . . 158 |
| SS1-scFv | 161 . . . 400 |
| GS-linker | 403 . . . 412 |
| KIR2DS2-derived seq | 413 . . . 487 |

Sequence
MGGLEPCSRF LLLPLLLAVS GLRPVQVQAQ SDCSCSTVSP GVLAGIVMGD LVLTVLIALA

VYFLGRLVPR GRGAAEAATR KQRITETESP YQELQGQRSD VYSDLNTQRP YYKVEGGGEG

RGSLLTCGDV EENPGPRMAL PVTALLLPLA LLLHAARPGS QVQLQQSGPE LEKPGASVKI

SCKASGYSFT GYTMNWVKQS HGKSLEWIGL ITPYNGASSY NQKFRGKATL TVDKSSSTAY

MDLLSLTSED SAVYFCARGG YDGRGFDYWG QGTTVTVSSG GGGSGGGGSS GGGSDIELTQ

```
SPAIMSASPG EKVTMTCSAS SSVSYMHWYQ QKSGTSPKRW IYDTSKLASG VPGRFSGSGS

GNSYSLTISS VEAEDDATYY CQQWSKHPLT YGAGTKLEIK ASGGGGSGGG GSSPTEPSSK

TGNPRHLHVL IGTSVVKIPF TILLFFLLHR WCSNKKNAAV MDQEPAGNRT VNSEDSDEQD

HQEVSYA
```

The nucleic acid and amino acid sequence of an NKR-CAR comprising an antigen binding domain that binds to mesothelin, e.g., SS1, and a TNKp46 cytoplasmic domain, as well as a FcεRγ adaptor molecule linked via the peptide cleavage site T2A is provided below:

FCERG-T2A-SS1-TNKp46 (SEQ ID NO: 334)
1365 bp DNA

| FEATURES | Location |
| --- | --- |
| FCERG | 1 . . . 258 |
| T2A | 271 . . . 327 |
| Signal peptide from CD8alpha | 331 . . . 393 |
| SS1-scFv | 400 . . . 1119 |
| GS-linker | 1126 . . . 1155 |
| NKp46-derived sequence | 1156 . . . 1365 |
| Sequence | |

```
ATGATTCCAG CAGTGGTCTT GCTCTTACTC CTTTTGGTTG AACAAGCAGC GGCCCTGGGA

GAGCCTCAGC TCTGCTATAT CCTGGATGCC ATCCTGTTTC TGTATGGAAT TGTCCTCACC

CTCCTCTACT GCCGACTGAA GATCCAAGTG CGAAAGGCAG CTATAACCAG CTATGAGAAA

TCAGATGGTG TTTACACGGG CCTGAGCACC AGGAACCAGG AGACTTACGA GACTCTGAAG

CATGAGAAAC CACCACAGTC CGGAGGCGGC GGAGAGGGCA GAGGAAGTCT TCTAACATGC

GGTGACGTGG AGGAGAATCC CGGCCCTAGG ATGGCCTTAC CAGTGACCGC CTTGCTCCTG

CCGCTGGCCT TGCTGCTCCA CGCCGCCAGG CCGGGATCCC AGGTACAACT GCAGCAGTCT

GGGCCTGAGC TGGAGAAGCC TGGCGCTTCA GTGAAGATAT CCTGCAAGGC TTCTGGTTAC

TCATTCACTG GCTACACCAT GAACTGGGTG AAGCAGAGCC ATGGAAAGAG CCTTGAGTGG

ATTGGACTTA TTACTCCTTA CAATGGTGCT TCTAGCTACA ACCAGAAGTT CAGGGGCAAG

GCCACATTAA CTGTAGACAA GTCATCCAGC ACAGCCTACA TGGACCTCCT CAGTCTGACA

TCTGAAGACT CTGCAGTCTA TTTCTGTGCA AGGGGGGGTT ACGACGGGAG GGGTTTTGAC

TACTGGGGCC AAGGGACCAC GGTCACCGTC TCCTCAGGTG GAGGCGGTTC AGGCGGCGGT

GGCTCTAGCG GTGGTGGATC GGACATCGAG CTCACTCAGT CTCCAGCAAT CATGTCTGCA

TCTCCAGGGG AGAAGGTCAC CATGACCTGC AGTGCCAGCT CAAGTGTAAG TTACATGCAC

TGGTACCAGC AGAAGTCAGG CACCTCCCCC AAAAGATGGA TTTATGACAC ATCCAAACTG

GCTTCTGGAG TCCCAGGTCG CTTCAGTGGC AGTGGGTCTG GAAACTCTTA CTCTCTCACA

ATCAGCAGCG TGGAGGCTGA AGATGATGCA ACTTATTACT GCCAGCAGTG GAGTAAGCAC

CCTCTCACGT ACGGTGCTGG GACAAAGTTG GAAATCAAAG CTAGCGGTGG CGGAGGTTCT

GGAGGTGGGG GTTCCTTAAC CACAGAGACG GGACTCCAGA AGACCATGC CCTCTGGGAT

CACACTGCCC AGAATCTCCT TCGGATGGGC CTGGCCTTTC TAGTCCTGGT GGCTCTAGTG

TGGTTCCTGG TTGAAGACTG GCTCAGCAGG AAGAGGACTA GAGAGCGAGC CAGCAGAGCT

TCCACTTGGG AAGGCAGGAG AAGGCTGAAC ACACAGACTC TTTGA
```

-continued

| FCERG-T2A-SS1-TNKp46 (SEQ ID NO: 335) 455aa Protein ||
|---|---|
| FEATURES | Location |
| FCERG | 1 . . . 86 |
| T2A | 91 . . . 109 |
| Signal peptide from CD8alpha | 111 . . . 131 |
| SS1-scFv | 134 . . . 373 |
| GS-linker | 376 . . . 385 |
| NKp46-derived sequence | 386 . . . 454 |

Sequence
MIPAVVLLLL LLVEQAAALG EPQLCYILDA ILFLYGIVLT LLYCRLKIQV RKAAITSYEK

SDGVYTGLST RNQETYETLK HEKPPQSGGG GEGRGSLLTC GDVEENPGPR MALPVTALLL

PLALLLHAAR PGSQVQLQQS GPELEKPGAS VKISCKASGY SFTGYTMNWV KQSHGKSLEW

IGLITPYNGA SSYNQKFRGK ATLTVDKSSS TAYMDLLSLT SEDSAVYFCA RGGYDGRGFD

YWGQGTTVTV SSGGGGSGGG GSSGGGSDIE LTQSPAIMSA SPGEKVTMTC SASSSVSYMH

WYQQKSGTSP KRWIYDTSKL ASGVPGRFSG SGSGNSYSLT ISSVEAEDDA TYYCQQWSKH

PLTYGAGTKL EIKASGGGGS GGGGSLTTET GLQKDHALWD HTAQNLLRMG LAFLVLVALV

WFLVEDWLSR KRTRERASRA STWEGRRRLN TQTL

The nucleic acid and amino acid sequence of an NKR-CAR comprising an antigen binding domain that binds to CD19 and a KIRS2 cytoplasmic domain, as well as a DAP12 adaptor molecule linked via the peptide cleavage site T2A is provided below:

| DAP12-T2A-CD19-KIRS2 (SEQ ID NO: 336) 1470 bp DNA ||
|---|---|
| FEATURES | Location |
| DAP12 | 1 . . . 339 |
| T2A sequence | 352 . . . 408 |
| CD19-scFv | 481 . . . 481 |
| GS-linker | 1213 . . . 1242 |
| KIR2DS2-derived sequence | 1243 . . . 1470 |

Sequence
ATGGGGGGAC TTGAACCCTG CAGCAGGTTC CTGCTCCTGC CTCTCCTGCT GGCTGTAAGT

GGTCTCCGTC CTGTCCAGGT CCAGGCCCAG AGCGATTGCA GTTGCTCTAC GGTGAGCCCG

GGCGTGCTGG CAGGGATCGT GATGGGAGAC CTGGTGCTGA CAGTGCTCAT TGCCCTGGCC

GTGTACTTCC TGGGCCGGCT GGTCCCTCGG GGGCGAGGGG CTGCGGAGGC AGCGACCCGG

AAACAGCGTA TCACTGAGAC CGAGTCGCCT TATCAGGAGC TCCAGGGTCA GAGGTCGGAT

GTCTACAGCG ACCTCAACAC ACAGAGGCCG TATTACAAAG TCGAGGGCGG CGGAGAGGGC

AGAGGAAGTC TTCTAACATG CGGTGACGTG GAGGAGAATC CCGGCCCTAG GATGGCCTTA

CCAGTGACCG CCTTGCTCCT GCCGCTGGCC TTGCTGCTCC ACGCCGCCAG GCCGGGATCC

GACATCCAGA TGACACAGAC TACATCCTCC CTGTCTGCCT CTCTGGGAGA CAGAGTCACC

ATCAGTTGCA GGGCAAGTCA GGACATTAGT AAATATTTAA ATTGGTATCA GCAGAAACCA

GATGGAACTG TTAAACTCCT GATCTACCAT ACATCAAGAT TACACTCAGG AGTCCCATCA

AGGTTCAGTG GCAGTGGGTC TGGAACAGAT TATTCTCTCA CCATTAGCAA CCTGGAGCAA

GAAGATATTG CCACTTACTT TTGCCAACAG GGTAATACGC TTCCGTACAC GTTCGGAGGG

GGGACTAAGT TGGAAATAAC AGGTGGCGGT GGCTCGGGCG GTGGTGGGTC GGGTGGCGGC

```
GGATCTGAGG TGAAACTGCA GGAGTCAGGA CCTGGCCTGG TGGCGCCCTC ACAGAGCCTG

TCCGTCACAT GCACTGTCTC AGGGGTCTCA TTACCCGACT ATGGTGTAAG CTGGATTCGC

CAGCCTCCAC GAAAGGGTCT GGAGTGGCTG GGAGTAATAT GGGGTAGTGA AACCACATAC

TATAATTCAG CTCTCAAATC CAGACTGACC ATCATCAAGG ACAACTCCAA GAGCCAAGTT

TTCTTAAAAA TGAACAGTCT GCAAACTGAT GACACAGCCA TTTACTACTG TGCCAAACAT

TATTACTACG GTGGTAGCTA TGCTATGGAC TACTGGGGTC AAGGAACCTC AGTCACCGTC

TCCTCAGCTA GCGGTGGCGG AGGTTCTGGA GGTGGGGGTT CCTCACCCAC TGAACCAAGC

TCCAAAACCG GTAACCCCAG ACACCTGCAT GTTCTGATTG GGACCTCAGT GGTCAAAATC

CCTTTCACCA TCCTCCTCTT CTTTCTCCTT CATCGCTGGT GCTCCAACAA AAAAAATGCT

GCTGTAATGG ACCAAGAGCC TGCAGGGAAC AGAACAGTGA ACAGCGAGGA TTCTGATGAA

CAAGACCATC AGGAGGTGTC ATACGCATAA
```

| DAP12-T2A-CD19-KIRS2 (SEQ ID NO: 337) | |
|---|---|
| 489 aa Protein | |
| FEATURES | Location |
| DAP12 | 1 . . . 113 |
| T2A seq | 118 . . . 136 |
| Signal_peptide from CD8alpha | 138 . . . 158 |
| CD19-scFv | 161 . . . 402 |
| GS-linker | 405 . . . 414 |
| KIR2DS2-derived seq | 415 . . . 489 |

```
Sequence
MGGLEPCSRF LLLPLLLAVS GLRPVQVQAQ SDCSCSTVSP GVLAGIVMGD LVLTVLIALA

VYFLGRLVPR GRGAAEAATR KQRITETESP YQELQGQRSD VYSDLNTQRP YYKVEGGGEG

RGSLLTCGDV EENPGPRMAL PVTALLLPLA LLLHAARPGS DIQMTQTTSS LSASLGDRVT

ISCRASQDIS KYLNWYQQKP DGTVKLLIYH TSRLHSGVPS RFSGSGSGTD YSLTISNLEQ

EDIATYFCQQ GNTLPYTFGG GTKLEITGGG GSGGGGSGGG GSEVKLQESG PGLVAPSQSL

SVTCTVSGVS LPDYGVSWIR QPPRKGLEWL GVIWGSETTY YNSALKSRLT IIKDNSKSQV

FLKMNSLQTD DTAIYYCAKH YYYGGSYAMD YWGQGTSVTV SSASGGGGSG GGGSSPTEPS

SKTGNPRHLH VLIGTSVVKI PFTILLFFLL HRWCSNKKNA AVMDQEPAGN RTVNSEDSDE

QDHQEVSYA*
```

In an embodiment, the transmembrane domain is a KIR2DS2 transmembrane domain. The amino acid sequence of a KIR2DS2 transmembrane domain is as follows:

(SEQ ID NO: 357)
VLIGTSVVKIPFTILLFFLL

In an embodiment, the transmembrane domain is a KIR2DL3 transmembrane domain. The amino acid sequence of a KIR2DL3 transmembrane domain is as follows:

(SEQ ID NO: 358)
VLIGTSVVIILFILLLFFLL

In an embodiment, the transmembrane domain is a NKp46 transmembrane domain. The amino acid sequence of a NKp46 transmembrane domain is as follows:

(SEQ ID NO: 359)
LLRMGLAFLVLVALVWFLVEDWLS

Figure 29:
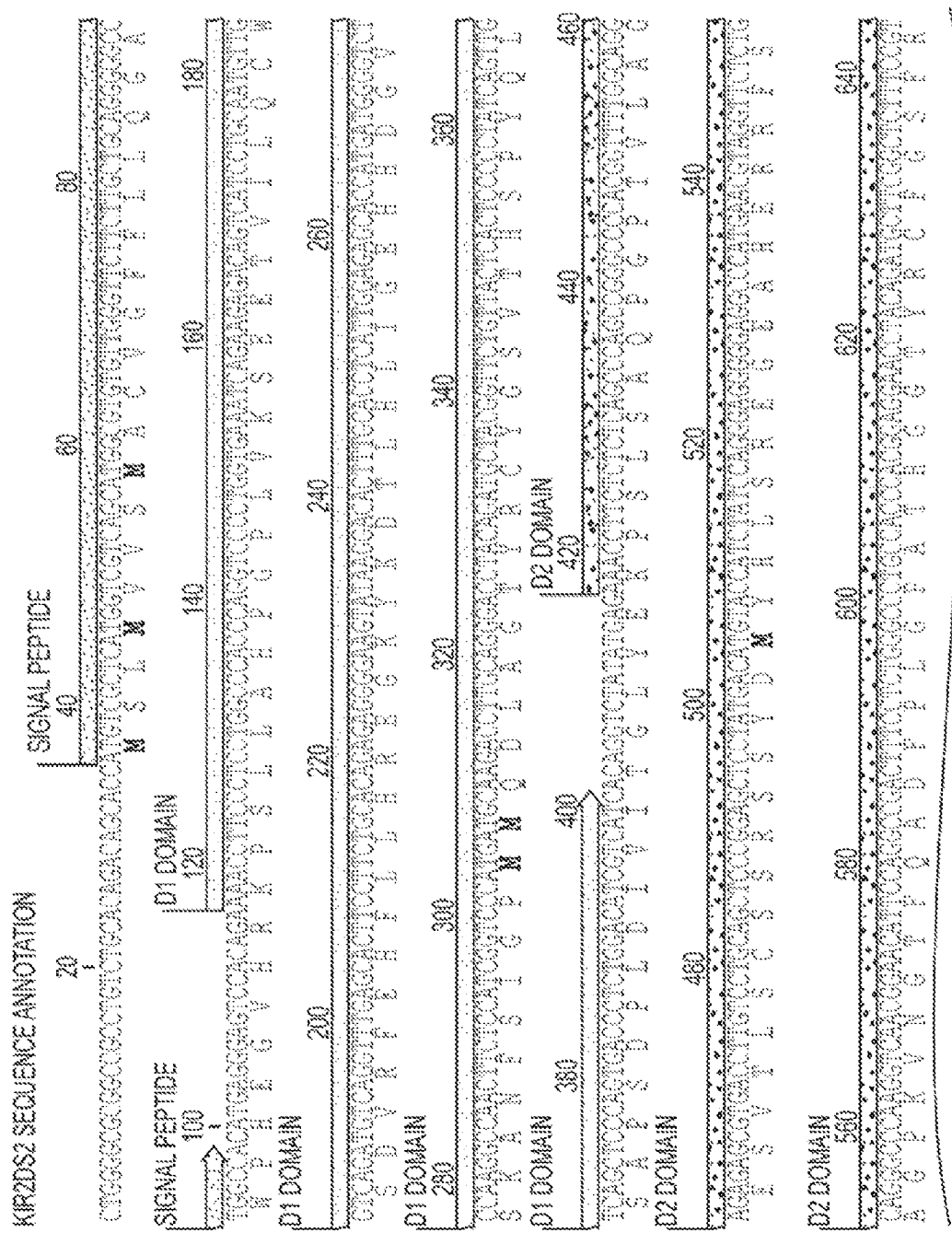
FIG. 29 shows a KIR2DS2 Sequence Annotation. The nucleotide sequence provided in FIG. 29 is designated SEQ ID NO: 342. The amino acid sequence provided in FIG. 29 is designated SEQ ID NO: 343.
Figure 29:
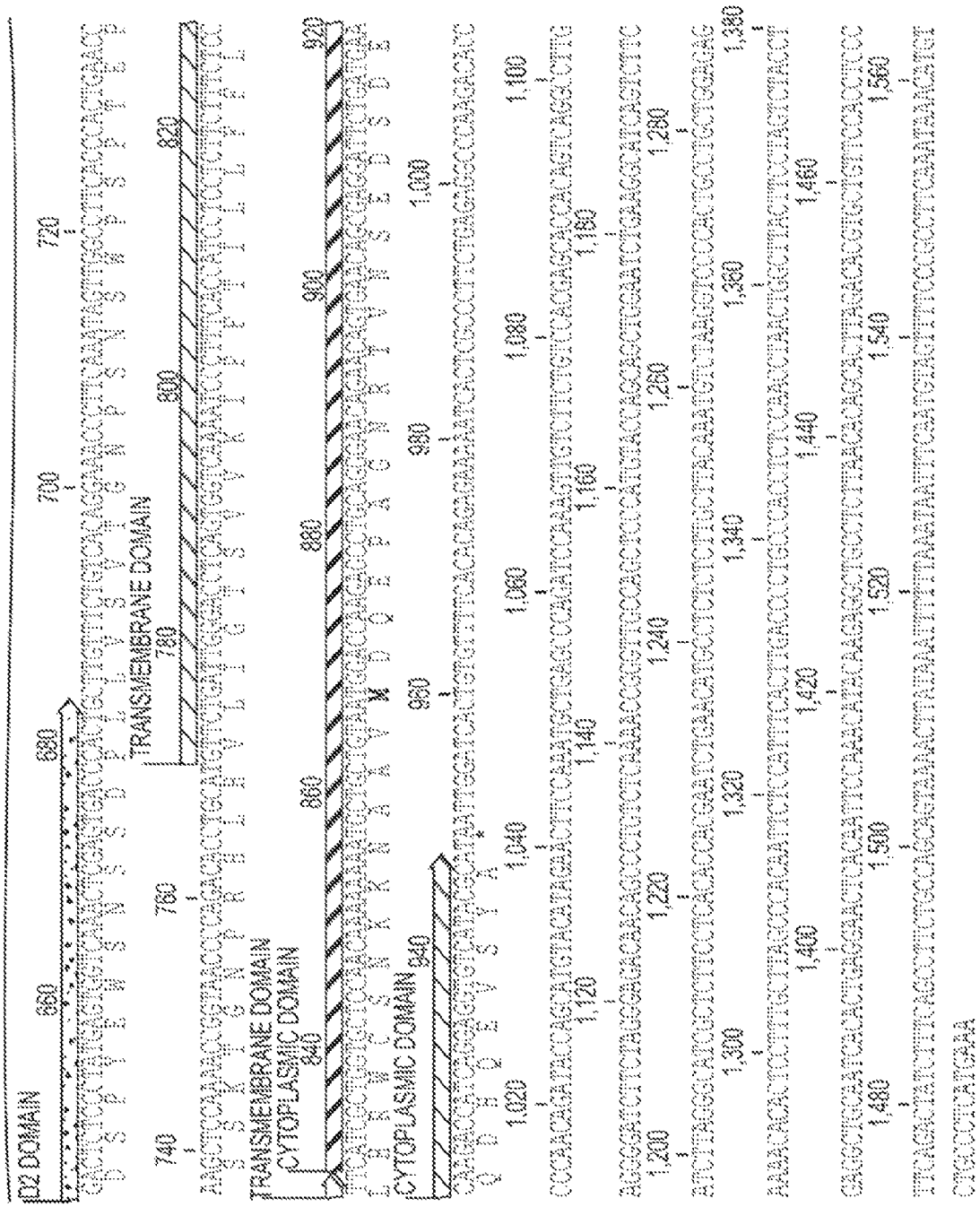

In an embodiment, the cytoplasmic domain is derived from KIR2DS2, e.g., a naturally occurring KIRS2DS2 as shown in FIG. 29. The amino acid sequence of a KIR2DS2-derived cytoplasmic domain, also referred to herein as a KIRS2 domain, is as follows:

(SEQ ID NO: 360)
HRWCSNKKNAAVMDQEPAGNRTVNSEDSDEQDHQEVSYA

Figure 30:
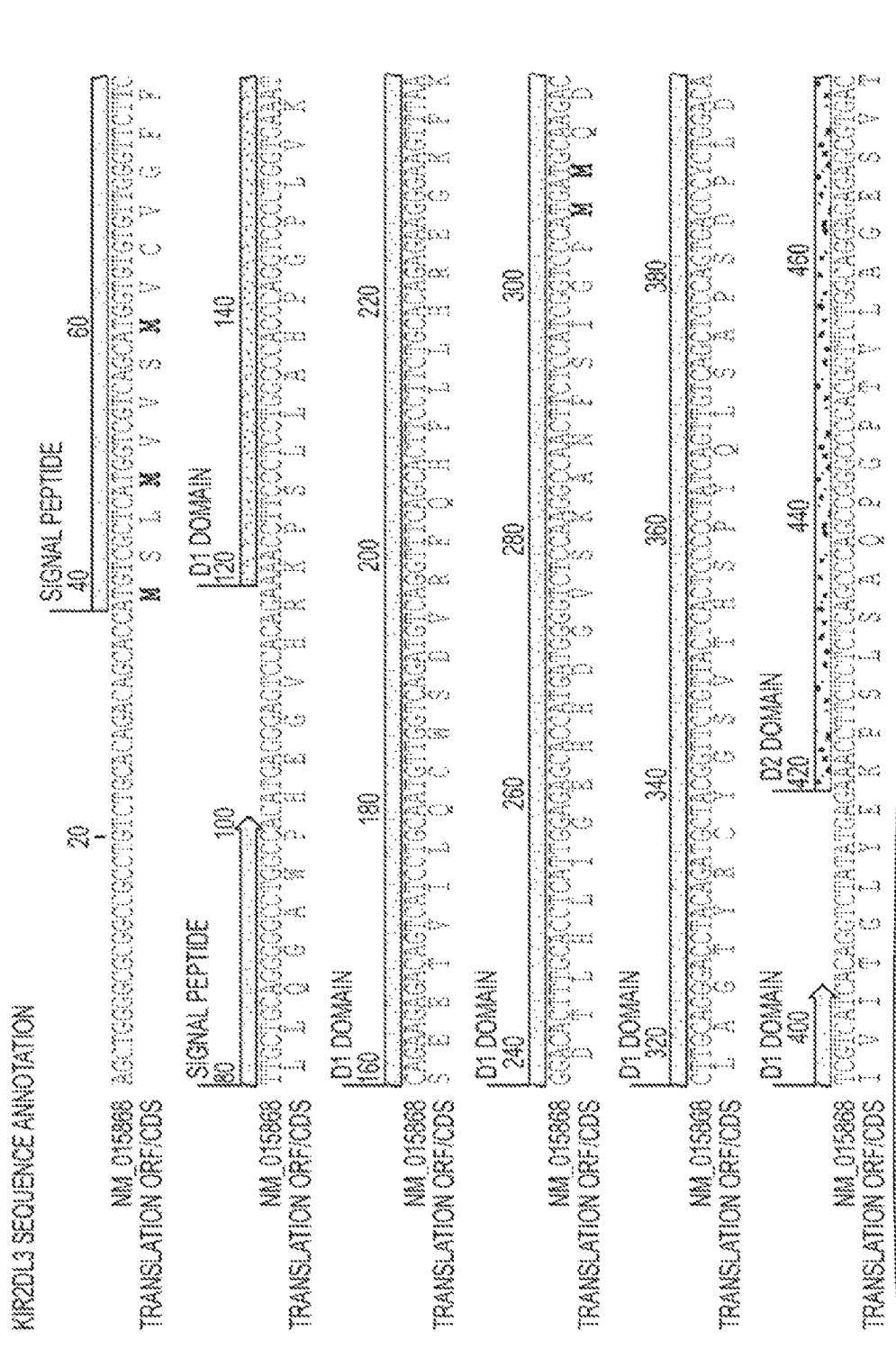
FIG. 30 shows a KIR2DL3 Sequence Annotation. The nucleotide sequence provided in FIG. 30 is designated SEQ ID NO: 344. The amino acid sequence provided in FIG. 30 is designated SEQ ID NO: 345.
Figure 30:
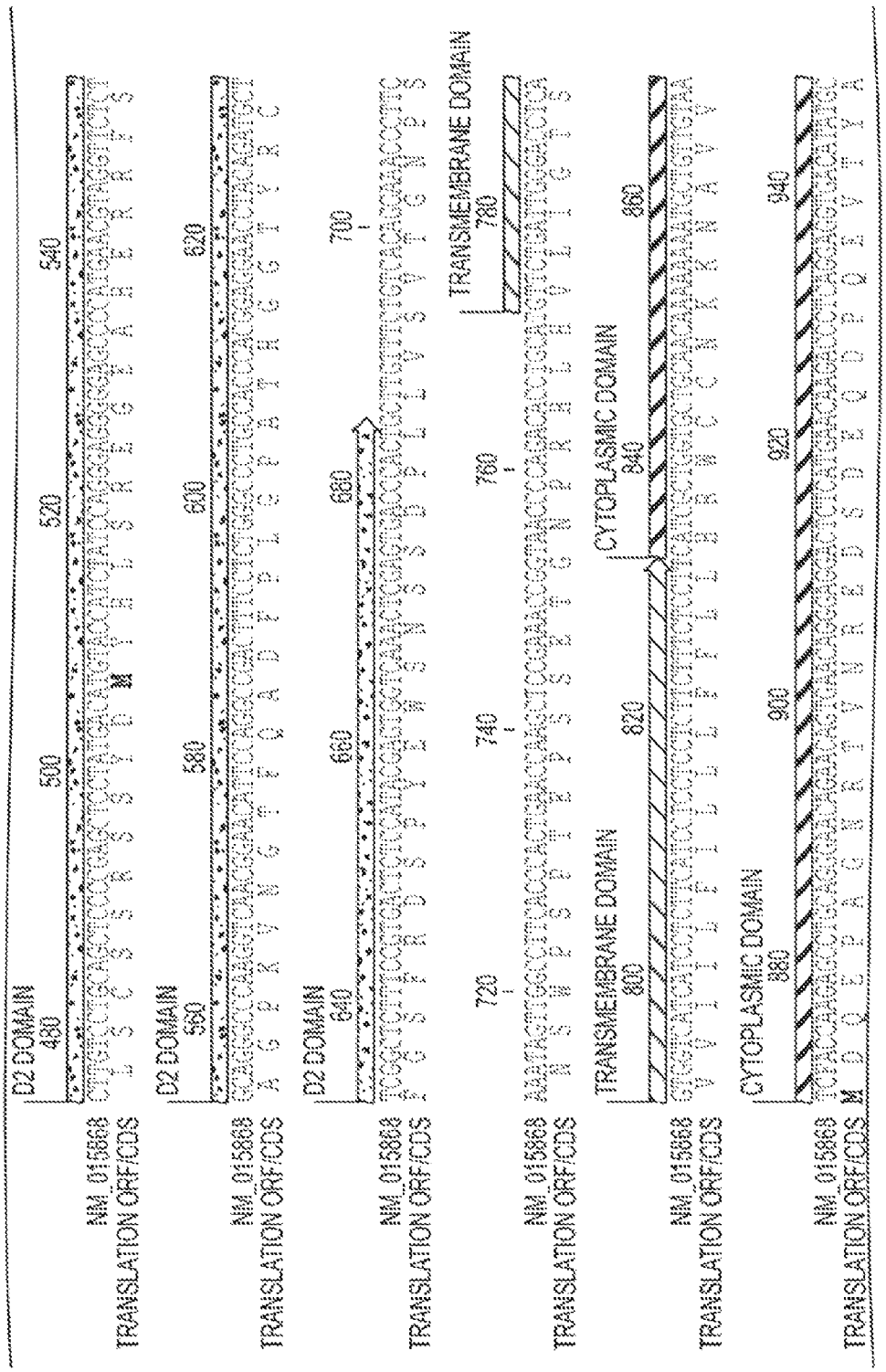
Figure 30:
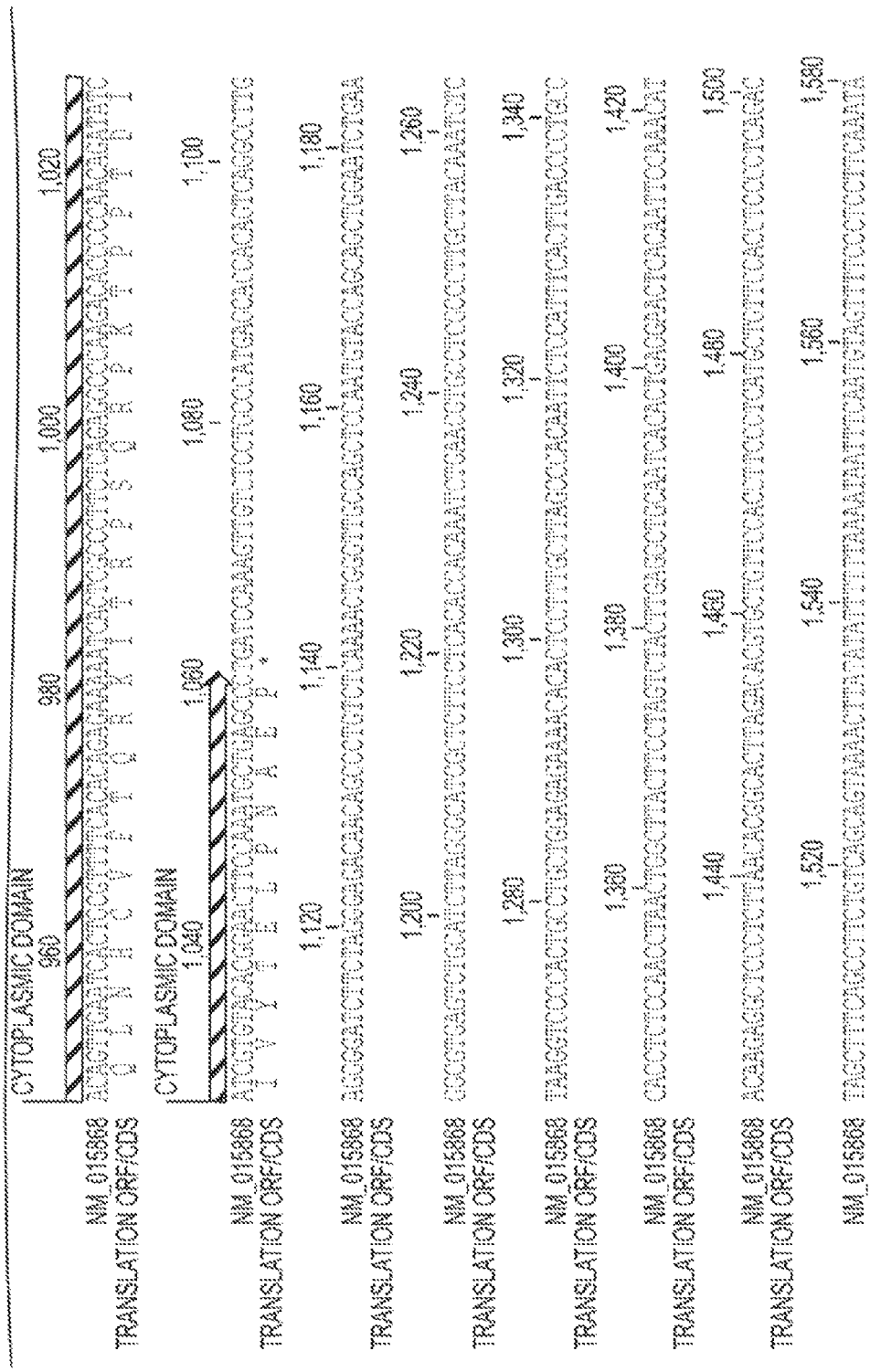

In an embodiment, the cytoplasmic domain is derived from KIR2DL3, e.g., a naturally occurring KIR2DL3 as shown in FIG. 30. The amino acid sequence of a KIR2DL3-derived cytoplasmic domain, also referred to herein as a KIRL3 domain, is as follows:

(SEQ ID NO: 361)
HRWCCNKKNAVVMDQEPAGNRTVNREDSDEQDPQEVTYAQLNHCVFTQRK

ITHPSQRPKTPPTDIIVYTELPNAEP

Figure 31:
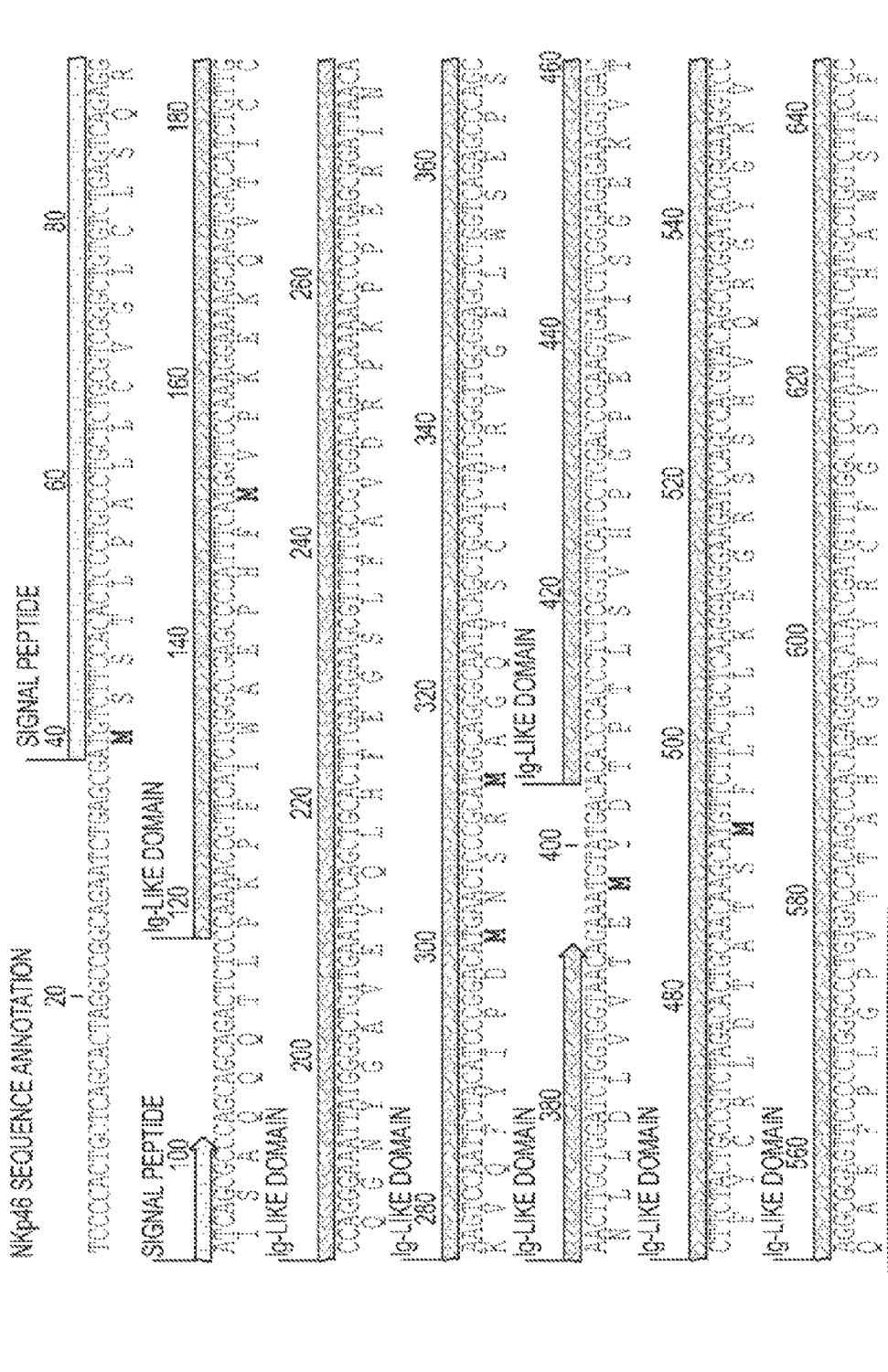
FIG. 31 shows a NKp46 Sequence Annotation. The nucleotide sequence provided in FIG. 31 is designated SEQ ID NO: 346. The amino acid sequence provided in FIG. 31 is designated SEQ ID NO: 347.
Figure 31:
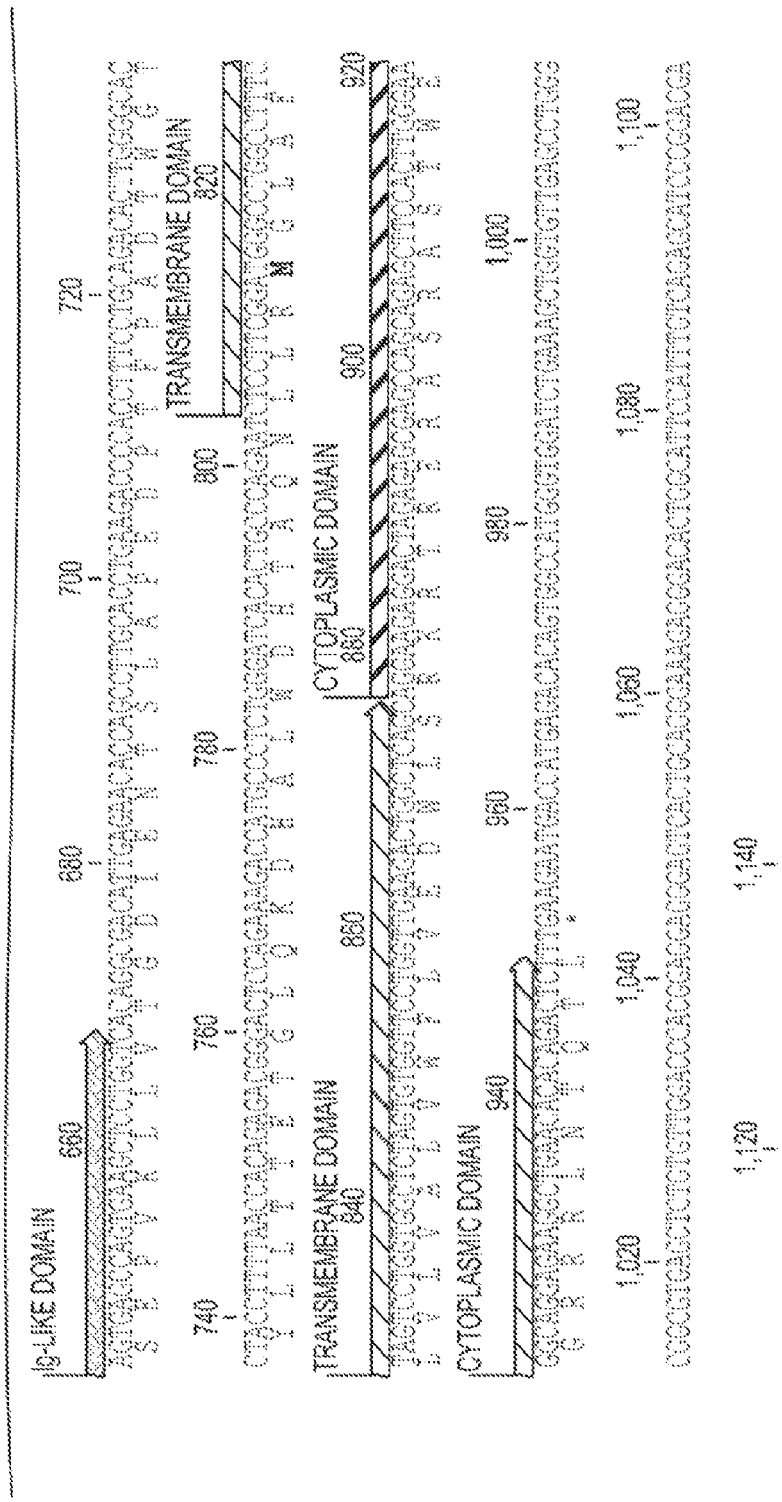
Figure 32:
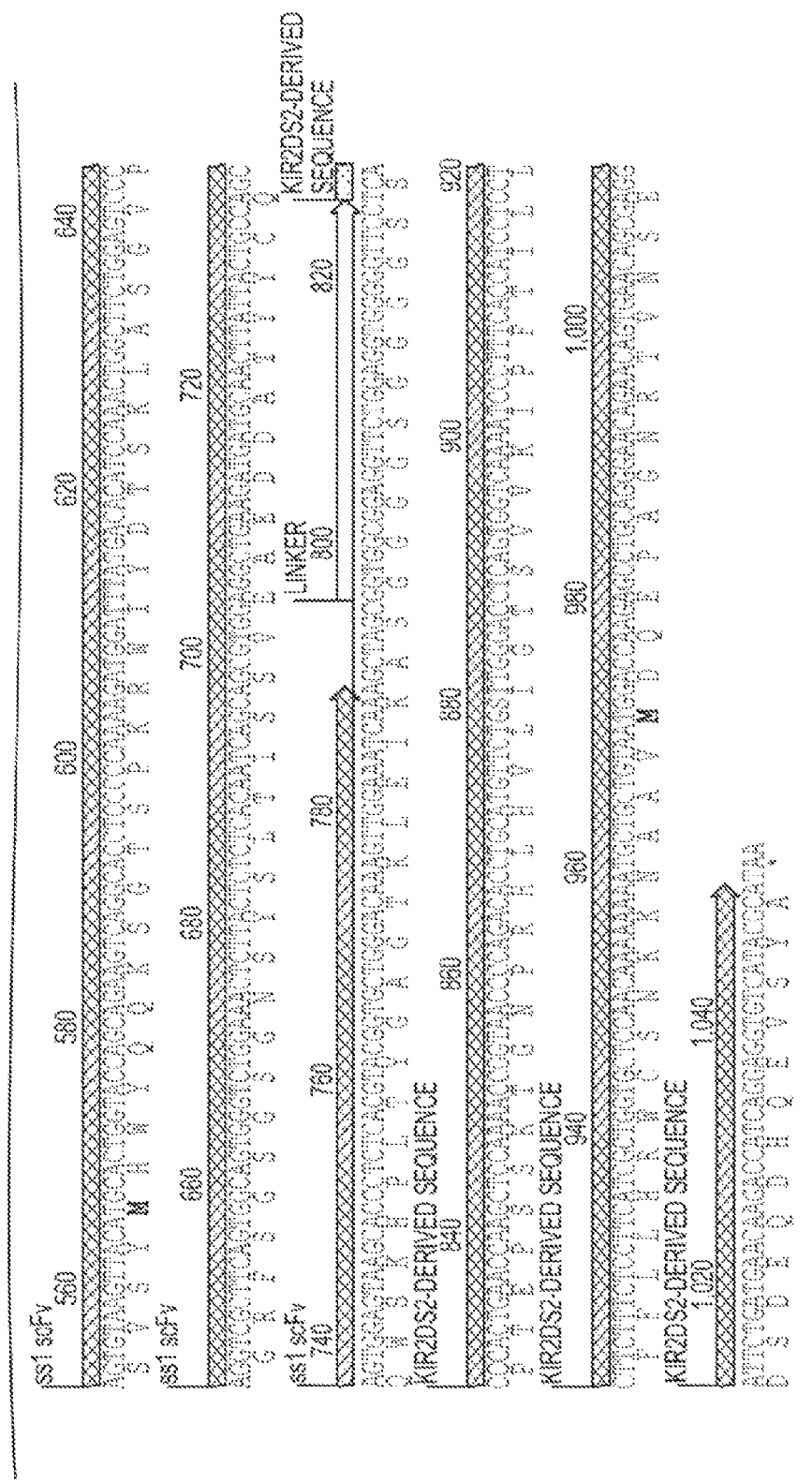
FIG. 32 shows a SS1-KIRS2 Sequence Annotation. The nucleotide sequence provided in FIG. 32 is designated SEQ ID NO: 348. The amino acid sequence provided in FIG. 32 is designated SEQ ID NO: 349.
Figure 33:
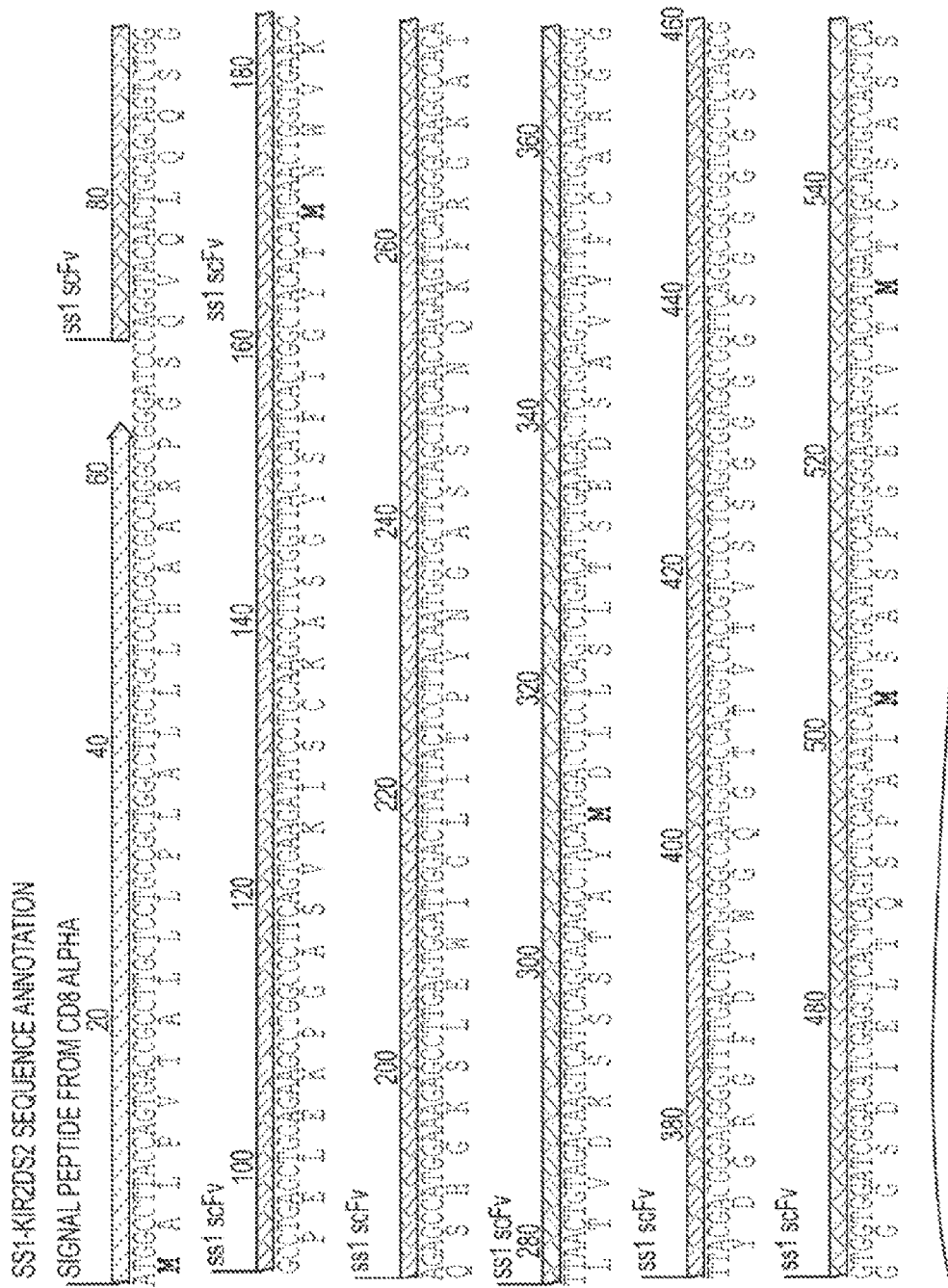
FIG. 33 shows a SS1-KIR2DS2 Sequence Annotation. The nucleotide sequence provided in FIG. 33 is designated SEQ ID NO: 350. The amino acid sequence provided in FIG. 33 is designated SEQ ID NO: 351.
Figure 33:
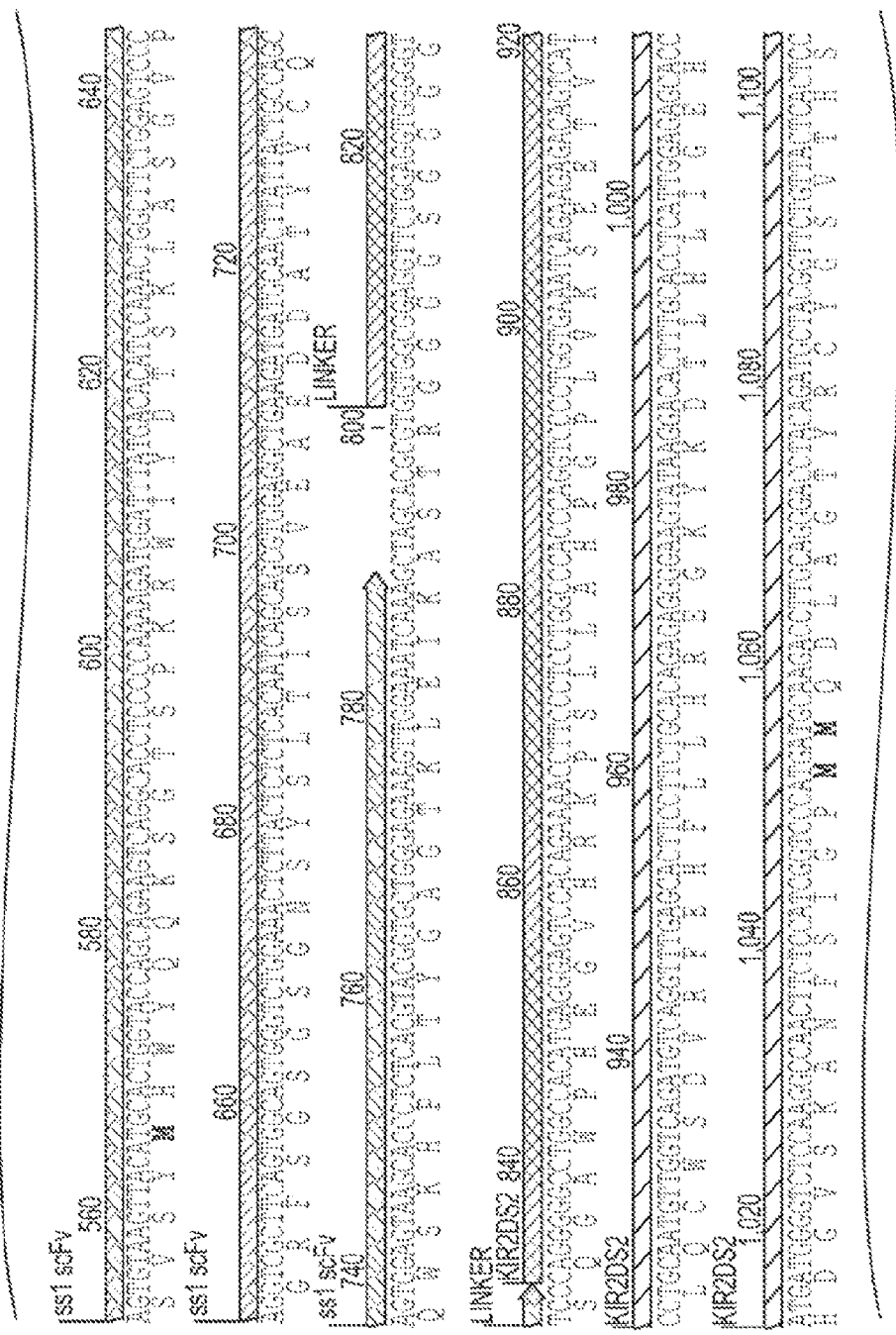
Figure 33:
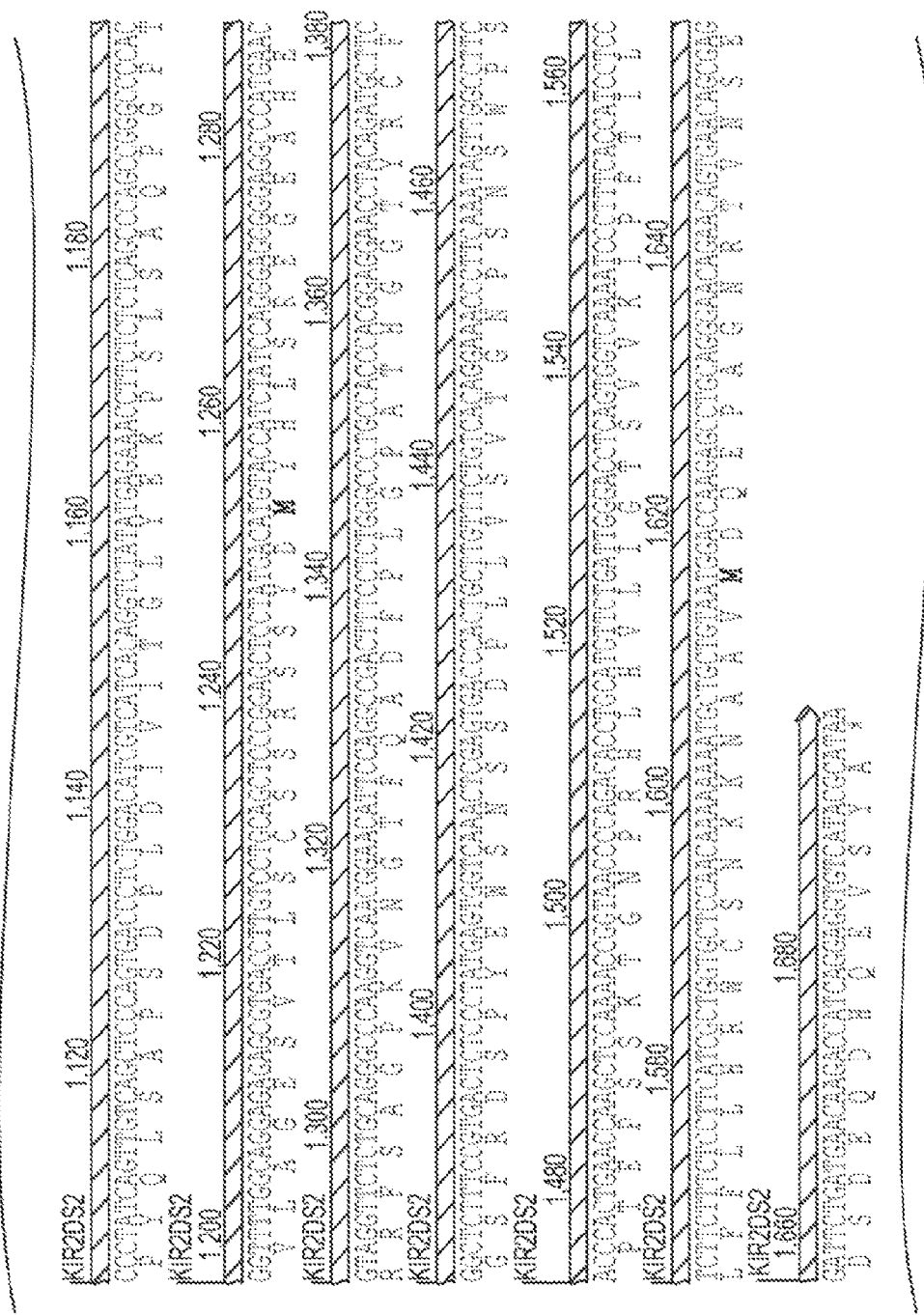
Figure 34:
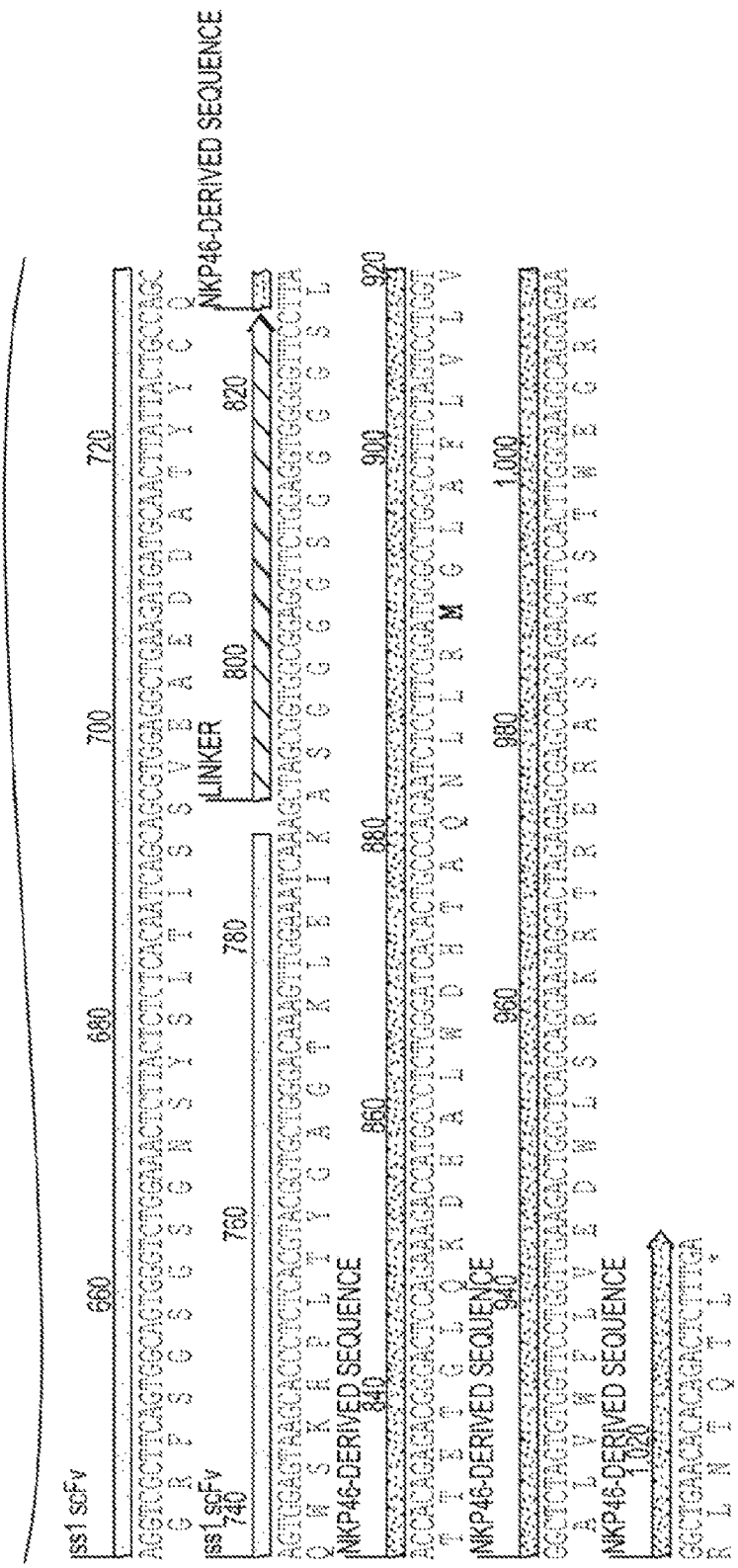
FIG. 34 shows a SS1-tNKp46 Sequence Annotation. The nucleotide sequence provided in FIG. 34 is designated SEQ ID NO: 352. The amino acid sequence provided in FIG. 34 is designated SEQ ID NO: 353.
Figure 35:
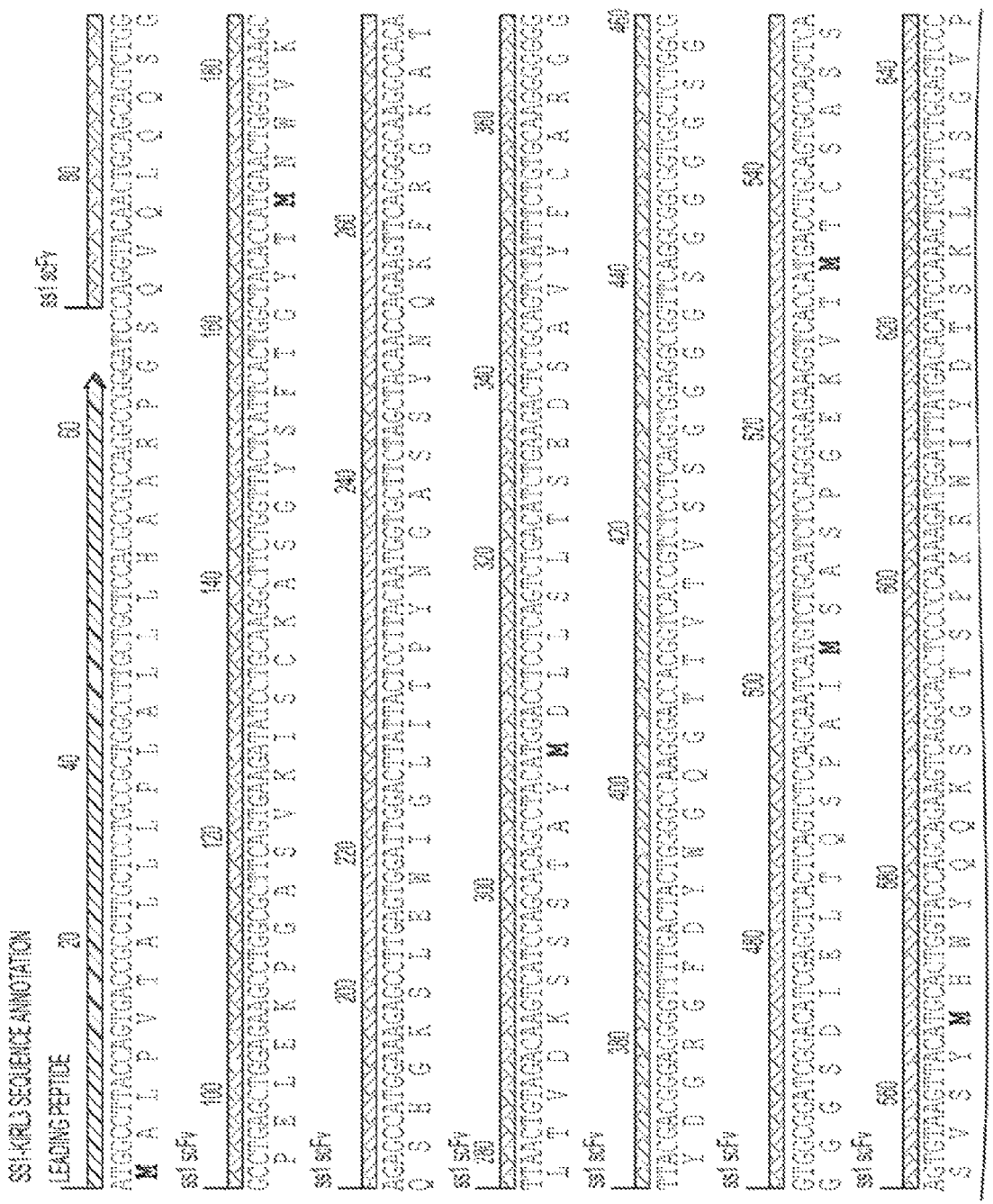
FIG. 35 shows a SS1-KIRL3 Sequence Annotation. The nucleotide sequence provided in FIG. 35 is designated SEQ ID NO: 354. The amino acid sequence provided in FIG. 35 is designated SEQ ID NO: 355.
Figure 35:
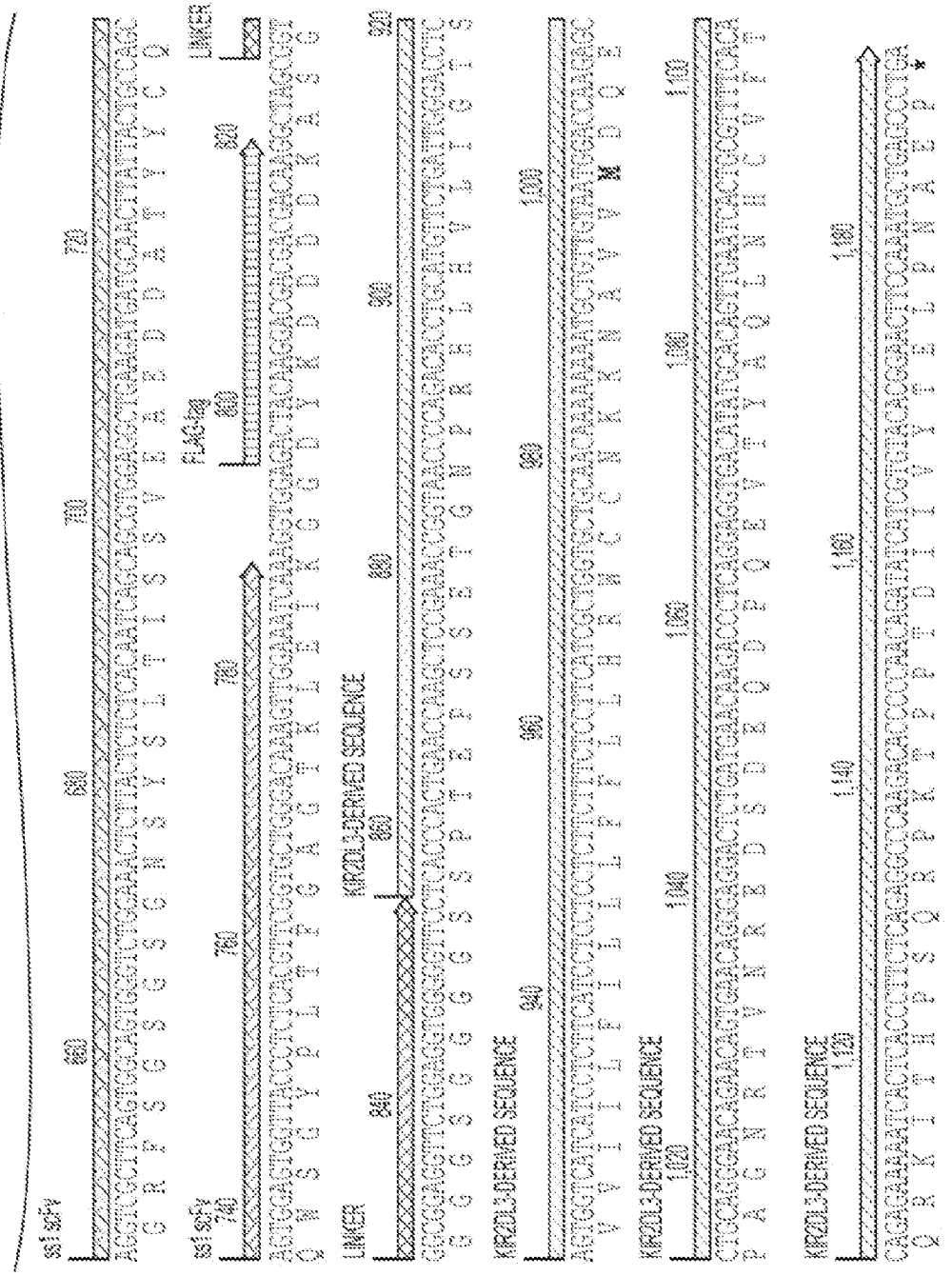

In an embodiment, the cytoplasmic domain is derived from NKp46, e.g., a naturally occurring NKp46 as shown in FIG. 31. The amino acid sequence of a NKp46-derived cytoplasmic domain, also referred to herein as a tNKp46 or TNKp46 domain, is as follows:

(SEQ ID NO: 362)
RKRTRERASRASTWEGRRRLNTQTL

In an embodiment, the transmembrane and cytoplasmic domain, collectively, comprise the amino acid sequence provided below:

(SEQ ID NO: 371)
VLIGTSVVKIPFTILLFFLLHRWCSNKKNAAVMDQEPAGNRTVNSEDSDE

QDHQEVSYA

The nucleic acid and amino acid sequences for a KIR-CAR comprising a human antigen binding domain that binds to mesothelin are also provided herein. For example, the nucleic acid sequence of a KIR-CAR comprising a leader sequence, human mesothelin-specific antigen binding domain M5, and a KIRS2 cytoplasmic domain is provided below. The underlined sequence designates the sequence of the M5 scFv, which can be readily interchanged with any other antigen binding domain, e.g., human anti-mesothelin scFv, described herein.

(SEQ ID NO: 363)
Atggccttaccagtgaccgccttgctcctgccgctggccttgctgctcca cgccgccaggccgggatcc<u>caagtccaactcgttcaatcaggcgcagaag</u>

<u>tcgaaaagcccggagcatcagtcaaagtctcttgcaaggcttccggctac</u>

<u>accttcacggactactacatgcactgggtgcgccaggctccaggccaggg</u>

<u>actggagtggatgggatggatcaacccgaattccgggggaactaactacg</u>

<u>cccagaagtttcagggccgggtgactatgactcgcgataccctcgatctcg</u>

<u>actgcgtacatggagctcagccgcctccggtcggacgataccgccgtgta</u>

<u>ctattgtgcgtcgggatgggacttcgactactgggggcagggcactctgg</u>

<u>tcactgtgtcaagcggaggaggtggatcaggtggaggtggaagcgggga</u>

<u>ggaggttccggcggcggaggatcagatatcgtgatgacgcaatcgccttc</u>

<u>ctcgttgtccgcatccgtgggagacagggtgaccattacttgcagagcgt</u>

<u>cccagtccattcggtactacctgtcgtggtaccagcagaagccggggaaa</u>

<u>gccccaaaactgcttatctatactgcctcgatcctccaaaacggcgtgcc</u>

<u>atcaagattcagcggttcgggcagcgggaccgactttaccctgactatca</u>

<u>gcagcctgcagccggaagatttcgccacgtactactgcctgcaaacctac</u>

<u>accacccggacttcggacctggaaccaaggtggagatcaaggctagcgg</u> tggcggaggttctggaggtgggggttcctcacccactgaaccaagctcca aaacggtaaccccagacacctgcatgttctgattgggacctcagtggtc aaaatccctttcaccatcctcctcttctttctccttcatcgctggtgctc caacaaaaaaaatgctgctgtaatggaccaagagcctgcagggaacagaa cagtgaacagcgaggattctgatgaacaagaccatcaggaggtgtcatac gcataa The amino acid sequence of the KIR-CAR comprising a leader sequence, human mesothelin-specific antigen binding domain M5, and a KIRS2 cytoplasmic domain is provided below. The underlined sequence designates the sequence of the M5 scFv, which can be readily interchanged with any other antigen binding domain, e.g., human anti-mesothelin scFv, described herein.

(SEQ ID NO: 364)
MALPVTALLLPLALLLHAARPGS<u>QVQLVQSGAEVEKPGASVKVSCKASGY</u>

<u>TFTDYYMHWVRQAPGQGLEWMGWINPNSGGTNYAQKFQGRVTMTRDTSIS</u>

<u>TAYMELSRLRSDDTAVYYCASGWDFDYWGQGTLVTVSSGGGGSGGGGSGG</u>

<u>GGSGGGGSDIVMTQSPSSLSASVGDRVTITCRASQSIRYYLSWYQQKPGK</u>

<u>APKLLIYTASILQNGVPSRFSGSGSGTDFTLTISSLQPEDFATYYCLQTY</u>

<u>TTPDFGPGTKVEIK</u>ASGGGGSGGGGSSPTEPSSKTGNPRHLHVLIGTSVV

KIPFTILLFFLLHRWCSNKKNAAVMDQEPAGNRTVNSEDSDEQDHQEVSY

A

In another example, the nucleic acid sequence of a multi-chain KIR-CAR comprising a leader sequence, human mesothelin-specific antigen binding domain M5, and a KIRS2 cytoplasmic domain, and further comprising a peptide cleavage site and an adaptor molecule DAP12 sequence, is provided below. The underlined sequence designates the sequence of the M5 scFv, which can be readily interchanged with any other antigen binding domain, e.g., human anti-mesothelin scFv, described herein. The bold sequence designates the DAP12 sequence and the italicized sequence designates the peptide cleavage site T2A.

(SEQ ID NO: 365)
ATGGGGGGACTTGAACCCTGCAGCAGGTTCCTGCTCCTGCCTCTCCTGCT

GGCTGTAAGTGGTCTCCGTCCTGTCCAGGTCCAGGCCCAGAGCGATTGCA

GTTGCTCTACGGTGAGCCCGGGCGTGCTGGCAGGGATCGTGATGGGAGAC

CTGGTGCTGACAGTGCTCATTGCCCTGGCCGTGTACTTCCTGGGCCGGCT

GGTCCCTCGGGGGCGAGGGGCTGCGGAGGCAGCGACCCGGAAACAGCGTA

TCACTGAGACCGAGTCGCCTTATCAGGAGCTCCAGGGTCAGAGGTCGGAT

GTCTACAGCGACCTCAACACACAGAGGCCGTATTACAAAT*ccggaggcag*

*cggagagggcagaggaagtcttctaacatgcggtgacgtggaggagaatc*

*ccggcc*CTAGGatggccttaccagtgaccgccttgctcctgccgctggcc ttgctgctccacgccgccaggccggGATCC<u>caagtccaactcgttcaatc</u>

<u>aggcgcagaagtcgaaaagcccggagcatcagtcaaagtctcttgcaagg</u>

<u>cttccggctacaccttcacggactactacatgcactgggtgcgccaggct</u>

<u>ccaggccagggactggagtggatgggatggatcaacccgaattccgggg</u>

<u>aactaactacgcccagaagtttcagggccgggtgactatgactcgcgata</u>

<u>cctcgatctcgactgcgtacatggagctcagccgcctccggtcggacgat</u>

```
accgccgtgtactattgtgcgtcgggatgggacttcgactactgggggca gggcactctggtcactgtgtcaagcggaggaggtggatcaggtggaggtg gaagcgggggaggaggttccggcggcggaggatcagatatcgtgatgacg caatcgccttcctcgttgtccgcatccgtgggagacagggtgaccattac ttgcagagcgtcccagtccattcggtactacctgtcgtggtaccagcaga agccggggaaagccccaaaactgcttatctatactgcctcgatcctccaa aacggcgtgccatcaagattcagcggttcgggcagcgggaccgactttac cctgactatcagcagcctgcagccggaagatttcgccacgtactactgcc tgcaaacctacaccaccccggacttcggacctggaaccaaggtggagatc aagGctagcggtggcggaggttctggaggtgggggttcctcacccactga accaagctccaaaaccggtaaccccagacacctgcatGTTCTGATTGGGA CCTCAGTGGTCAAAATCCCTTTCACCATCCTCCTCTTCTTTCTCCTTcat cgctggtgctccaacaaaaaaatgctgctgtaatggaccaagagcctgc agggaacagaacagtgaacagcgaggattctgatgaacaagaccatcagg aggtgtcatacgcataa
```

The amino acid sequence of the multi-chain KIR-CAR comprising a leader sequence, human mesothelin-specific antigen binding domain M5, and a KIRS2 cytoplasmic domain, and further comprising a peptide cleavage site and an adaptor molecule DAP12 sequence, is provided below. The underlined sequence designates the sequence of the M5 scFv, which can be readily interchanged with any other antigen binding domain, e.g., human anti-mesothelin scFv, described herein. The bold sequence designates the DAP12 sequence and the italicized sequence designates the peptide cleavage site T2A.

(SEQ ID NO: 366)
MGGLEPCSRFLLLPLLLAVSGLRPVQVQAQSDCSCSTVSPGVLAGIVMGD

LVLTVLIALAVYFLGRLVPRGRGAAEAATRKQRITETESPYQELQGQRSD

VYSDLNTQRPYYKS*GGSGEGRGSLLTCGDVEENPGPR*MALPVTALLLPLA

LLLHAARPGSQVQLVQSGAEVEKPGASVKVSCKASGYTFTDYYMHWVRQA

PGQGLEWMGWINPNSGGTNYAQKFQGRVTMTRDTSISTAYMELSRLRSDD

TAVYYCASGWDFDYWGQGTLVTVSSGGGGSGGGGSGGGGSGGGGSDIVMT

QSPSSLSASVGDRVTITCRASQSIRYYLSWYQQKPGKAPKLLIYTASILQ

NGVPSRFSGSGSGTDFTLTISSLQPEDFATYYCLQTYTTPDFGPGTKVEI

KASGGGGSGGGGSSPTEPSSKTGNPRHLHVLIGTSVVKIPFTILLFFLLH

RWCSNKKNAAVMDQEPAGNRTVNSEDSDEQDHQEVSYA

Cytoplasmic Domain

The cytoplasmic domain of a CAR described herein, e.g., a NKR-CAR or a TCAR, includes an intracellular signaling domain. An intracellular signaling domain is capable of activation of at least one of the normal effector functions of the immune effector cell in which the CAR has been introduced.

Examples of intracellular signaling domains for use in the CAR of the invention include the cytoplasmic sequences of the T cell receptor (TCR) and co-receptors that act in concert to initiate signal transduction following antigen receptor engagement, as well as any derivative or variant of these sequences and any recombinant sequence that has the same functional capability.

It is known that signals generated through the TCR alone are insufficient for full activation of the immune effector cell, e.g., T cell or NK cell, and that a secondary and/or costimulatory signal is also required. Thus, immune effector cell activation, e.g., T cell activation or NK cell activation, can be said to be mediated by two distinct classes of cytoplasmic signaling sequences: those that initiate antigen-dependent primary activation through the TCR (primary intracellular signaling domains) and those that act in an antigen-independent manner to provide a secondary or costimulatory signal (secondary cytoplasmic domain, e.g., a costimulatory domain).

Primary Intracellular Signaling Domain

In some embodiments, a primary intracellular signaling domain produces an intracellular signal when an extracellular domain, e.g., an antigen binding domain, to which it is fused binds cognate antigen. It is derived from a primary stimulatory molecule, e.g., it comprises intracellular sequence of a primary stimulatory molecule. It comprises sufficient primary stimulatory molecule sequence to produce an intracellular signal, e.g., when an antigen binding domain to which it is fused binds cognate antigen.

A primary stimulatory molecule, is a molecule, that upon binding cognate ligand, mediates an immune effector response, e.g., in the cell in which it is expressed. Typically, it generates an intracellular signal that is dependent on binding to a cognate ligand that comprises antigen. The TCR/CD3 complex is an exemplary primary stimulatory molecule; it generates an intracellular signal upon binding to cognate ligand, e.g., an MHC molecule loaded with a peptide. Typically, e.g., in the case of the TCR/CD3 primary stimulatory molecule, the generation of an intracellular signal by a primary intracellular signaling domain is dependent on binding of the primary stimulatory molecule to antigen.

Primary stimulation can mediate altered expression of certain molecules, such as downregulation of TGF-β, and/or reorganization of cytoskeletal structures, and the like. Stimulation, can, e.g., in the presence of costimulation, result in an optimization, e.g., an increase, in an immune effector function of the T cell. Stimulation, e.g., in the context of a T cell, can mediate a T cell response, e.g., proliferation, activation, differentiation, and the like.

In an embodiment, the primary intracellular signaling domain comprises a signaling motif, e.g., an immunoreceptor tyrosine-based activation motif or ITAMs. A primary intracellular signaling domain can comprise ITAM containing cytoplasmic signaling sequences from TCR zeta (CD3 zeta), FcR gamma, FcR beta, CD3 gamma, CD3 delta, CD3 epsilon, CD5, CD22, CD79a, CD79b, CD278 (also known as "ICOS"), FcεRI, DAP10, DAP12, and CD66d.

Exemplary ITAM-containing primary intracellular signaling domains are provided in Table 2.

TABLE 2

| Primary Intracellular Signaling Domains (e.g., ITAM-containing domains) | |
|---|---|
| CD3 zeta | CD5 |
| FcR gamma | CD22 |
| FcR beta | CD278 ("ICOS") |
| CD3 gamma | Fc epsilon RI (FcεRI) |
| CD3 delta | CD66d |
| CD3 epsilon | DAP10 |

TABLE 2-continued

Primary Intracellular Signaling Domains
(e.g., ITAM-containing domains)

| CD79a | DAP12 |
|---|---|
| CD79b | |

In one embodiment, a primary intracellular signaling domain comprises a modified ITAM domain, e.g., a mutated ITAM domain which has altered (e.g., increased or decreased) activity as compared to the native ITAM domain. In one embodiment, a primary intracellular signaling domain comprises a modified ITAM-containing primary intracellular signaling domain, e.g., an optimized and/or truncated ITAM-containing primary intracellular signaling domain. In an embodiment, a primary intracellular signaling domain comprises one, two, three, four or more ITAM motifs.

A primary intracellular signaling domain comprises a functional fragment, or analog, of a primary stimulatory molecule (e.g., CD3 zeta—GenBank Acc. No. BAG36664.1). It can comprise the entire intracellular region or a fragment of the intracellular region which is sufficient for generation of an intracellular signal when an antigen binding domain to which it is fused, or coupled by a dimerization switch, binds cognate antigen. In embodiments the primary intracellular signaling domain has at least 70, 75, 80, 85, 90, 95, 98, or 99% sequence identity with a naturally occurring primary stimulatory molecule, e.g., a primary stimulatory molecule disclosed in Table 2, e.g., a human (GenBank Acc. No. BAG36664.1), or other mammalian, e.g., a nonhuman species, e.g., rodent, monkey, ape or murine intracellular primary stimulatory molecule. In embodiments the primary intracellular signaling domain has at least 70, 75, 80, 85, 90, 95, 98, or 99% sequence identity with SEQ ID NO: 9 or SEQ ID NO: 10.

In embodiments the primary intracellular signaling domain, has at least 70, 75, 80, 85, 90, 95, 96, 97, 98, or 99% identity with, or differs by no more than 30, 25, 20, 15, 10, 5, 4, 3, 2, or 1 amino acid residues from the corresponding residues of a naturally occurring human primary stimulatory molecule, e.g., a naturally occurring human primary stimulatory molecule disclosed herein.

The intracellular signalling domain of the TCAR can comprise a primary intracellular signaling domain, e.g., CD3-zeta signaling domain, by itself or it can be combined with any other desired intracellular signaling domain(s) useful in the context of the TCAR. For example, the intracellular signaling domain of the TCAR can comprise a primary intracellular signaling domain, e.g., CD3 zeta chain portion, and one or more costimulatory signaling domains. Examples of costimulatory signaling domanis are provided below.

Costimulatory Signaling Domain

In an embodiment, a costimulatory signaling domain produces an intracellular signal when an extracellular domain, e.g., an antigen binding domain to which it is fused, or coupled by a dimerization switch, binds cognate ligand. It is derived from a costimulatory molecule. It comprises sufficient primary costimulatory molecule sequence to produce an intracellular signal, e.g., when an extracellular domain, e.g., an antigen binding domain, to which it is fused, or coupled by a dimerization switch, binds cognate ligand.

Costimulatory molecules are cell surface molecules, other than antigen receptors or their counter ligands, that promote an immune effector response. In some cases they are required for an efficient or enhanced immune response. Typically, a costimulatory molecule generates an intracellular signal that is dependent on binding to a cognate ligand that is, in embodiments, other than an antigen, e.g., the antigen recognized by an antigen binding domain of a T cell. Typically, signaling from a primary stimulatory molecule and a costimulatory molecule contribute to an immune effector response, and in some cases both are required for efficient or enhanced generation of an immune effector response.

A costimulatory signaling domain comprises a functional fragment, or analog, of a costimulatory molecule (e.g., 4-1BB, CD28, CD27, and ICOS). It can comprise the entire intracellular region or a fragment of the intracellular region of a costimulatory molecule which is sufficient for generation of an intracellular signal, e.g., when an antigen binding domain to which it is fused, or coupled by a dimerization switch, binds cognate antigen. In embodiments the costimulatory signaling domain has at least 70, 75, 80, 85, 90, 95, 98, or 99% sequence identity with a naturally occurring costimulatory molecule described herein, e.g., a human, or other mammalian, e.g., a nonhuman species, e.g., rodent, monkey, ape or murine intracellular costimulatory molecule. In embodiments the costimulatory domain has at least 70, 75, 80, 85, 90, 95, 98, or 99% sequence identity with SEQ ID NO: 7, SEQ ID NO: 8, SEQ ID NO: 36, or SEQ ID NO: 38.

Exemplary costimulatory signaling domains (intracellular signaling domains) are provided in Table 3.

TABLE 3

Costimulatory Signaling Domains (identified by the Costimulatory Molecules from which they are derived)

| CD27 | MHC class I molecule | SLAMF7 | ITGA4 | CD11c |
|---|---|---|---|---|
| CD28 | TNF receptor protein | NKp80 (KLRF1) | IA4 | ITGB1 |
| 4-1BB (CD137) | Immuno-globulin-like protein | NKp44 | CD49D | CD29 |
| OX40 | Cytokine receptor | NKp30 | ITGA6 | ITGB2 |
| CD30 | Integrin | NKp46 | VLA-6 | CD18 |
| CD40 | Signaling lymphocytic activation molecule (SLAM protein) | CD19 | CD49f | ITGB7 |
| ICOS (CD278) | Activating NK cell receptors | CD4 | ITGAD | NKG2D |
| ICAM-1 | Toll ligand receptor | CD8 alpha | CD11d | TNFR2 |
| LFA-1 (CD11a/CD18) | BTLA | CD8 beta | ITGAE | TRANCE/RANKL |
| CD2 | CDS | IL2R beta | CD103 | DNAM1 (CD226) |
| CD7 | ICAM-1 | IL2R gamma | ITGAL | SLAMF4 (CD244, 2B4) |
| LIGHT | GITR | IL7R alpha | CD11a | CD84 |
| NKG2C | BAFFR | ITGA4 | ITGAM | CD96 (Tactile) |
| B7-H3 | HVEM (LIGHTR) | VLA1 | CD11b | CEACAM1 |
| a ligand that specifically binds with CD83 | KIRDS2 | CD49a | ITGAX | CRTAM |

TABLE 3-continued

Costimulatory Signaling Domains (identified by the Costimulatory Molecules from which they are derived)

| Ly9 (CD229) | CD160 (BY55) | PSGL1 | CD100 (SEMA4D) | CD69 |
| --- | --- | --- | --- | --- |
| SLAMF6 (NTB-A, Ly108) | SLAM (SLAMF1, CD150, IPO-3) | BLAME (SLAMF8) | SELPLG (CD162) | LTBR |
| LAT | GADS | SLP-76 | PAG/Cbp | CD19a |

In embodiments the costimulatory signaling domain, has at least 70, 75, 80, 85, 90, 95, 96, 97, 98, or 99% identity with, or differs by no more than 30, 25, 20, 15, 10, 5, 4, 3, 2, or 1 amino acid residues from the corresponding residues of a naturally occurring human primary stimulatory molecule, e.g., a naturally occurring human costimulatory molecule disclosed herein, e.g., provided in Table 3.

The intracellular signaling sequences within the cytoplasmic domain of the TCAR may be linked to each other in a random or specified order. Optionally, a short oligo- or polypeptide linker, for example, between 2 and 10 amino acids (e.g., 2, 3, 4, 5, 6, 7, 8, 9, or 10 amino acids) in length may form the linkage between intracellular signaling sequences. In one embodiment, a glycine-serine doublet can be used as a suitable linker. In one embodiment, a single amino acid, e.g., an alanine, a glycine, can be used as a suitable linker.

In one aspect, the intracellular signaling domain is designed to comprise two or more, e.g., 2, 3, 4, 5, or more, costimulatory signaling domains. In an embodiment, the two or more, e.g., 2, 3, 4, 5, or more, costimulatory signaling domains, are separated by a linker molecule, e.g., a linker molecule described herein. In one embodiment, the intracellular signaling domain comprises two costimulatory signaling domains. In some embodiments, the linker molecule is a glycine residue. In some embodiments, the linker is an alanine residue.

In one aspect, the intracellular signaling domain is designed to comprise the signaling domain of CD3-zeta and the signaling domain of 4-1BB. In one aspect, the signaling domain of 4-1BB is a signaling domain comprising the amino acid sequence of SEQ ID NO: 7. In one aspect, the signaling domain of 4-1BB is encoded by the nucleic acid sequence of SEQ ID NO: 18. In one aspect, the signaling domain of CD3-zeta is a signaling domain comprising the amino acid sequence of SEQ ID NO: 9 (mutant CD3-zeta) or SEQ ID NO: 10 (wild type human CD3-zeta).

In one aspect, the intracellular signaling domain is designed to comprise the signaling domain of CD3-zeta and the signaling domain of CD27. In one aspect, the signaling domain of CD27 comprises the amino acid sequence of SEQ ID NO:8. In one aspect, the signalling domain of CD27 is encoded by the nucleic acid sequence of SEQ ID NO: 19. In one aspect, the signaling domain of CD3-zeta is a signaling domain comprising the amino acid sequence of SEQ ID NO: 9 (mutant CD3-zeta) or SEQ ID NO: 10 (wild type human CD3-zeta).

In one aspect, the intracellular signaling domain is designed to comprise the signaling domain of CD3-zeta and the signaling domain of CD28. In one aspect, the signaling domain of CD28 comprises an amino acid sequence of SEQ ID NO: 36. In one aspect, the signaling domain of CD28 is encoded by a nucleic acid sequence of SEQ ID NO: 37. In one aspect, the signaling domain of CD3-zeta is a signaling domain comprising the amino acid sequence of SEQ ID NO: 9 (mutant CD3-zeta) or SEQ ID NO: 10 (wild type human CD3-zeta).

In one aspect, the intracellular signaling domain is designed to comprise the signaling domain of CD3-zeta and the signaling domain of ICOS. In one aspect, the signaling domain of ICOS comprises an amino acid sequence of SEQ ID NO: 38. In one aspect, the signaling domain of ICOS is encoded by a nucleic acid sequence of SEQ ID NO:39. In one aspect, the signaling domain of CD3-zeta is a signaling domain comprising the amino acid sequence of SEQ ID NO: 9 (mutant CD3-zeta) or SEQ ID NO: 10 (wild type human CD3-zeta).

Transmembrane Domain

With respect to the transmembrane domain, in various embodiments, a CAR can be designed to comprise a transmembrane domain that is attached to the extracellular domain of the CAR. As described previously, the transmembrane domain of a NKR-CAR described herein can be a transmembrane domain of a NKR, e.g., a KIR transmembrane domain, a NCR transmembrane domain, a SLAMF transmembrane domain, a FcR transmembrane domain, e.g., a CD16 transmembrane domain or a CD64 transmembrane domain, or a Ly49 transmembrane domain. Alternatively, the transmembrane domain of a NKR-CAR or a TCAR described herein can be any one of the transmembrane domains described below.

The transmembrane domain may be derived either from a natural or from a recombinant source. Where the source is natural, the domain may be derived from any membrane-bound or transmembrane protein. In one aspect the transmembrane domain is capable of signaling to the intracellular domain(s) whenever the CAR has bound to a target. A transmembrane domain of particular use in this invention may include at least the transmembrane region(s) of e.g., the alpha, beta or zeta chain of the T-cell receptor, CD28, CD3 epsilon, CD45, CD4, CD5, CD8 (e.g., CD8 alpha, CD8 beta), CD9, CD16, CD22, CD33, CD37, CD64, CD80, CD86, CD134, CD137, CD154. In some embodiments, a transmembrane domain may include at least the transmembrane region(s) of, e.g., KIRDS2, OX40, CD2, CD27, LFA-1 (CD11a, CD18), ICOS (CD278), 4-1BB (CD137), GITR, CD40, BAFFR, HVEM (LIGHTR), SLAMF7, NKp80 (KLRF1), NKp44, NKp30, NKp46, CD160, CD19, IL2R beta, IL2R gamma, IL7Rα, ITGA1, VLA1, CD49a, ITGA4, IA4, CD49D, ITGA6, VLA-6, CD49f, ITGAD, CD11d, ITGAE, CD103, ITGAL, CD11a, LFA-1, ITGAM, CD11b, ITGAX, CD11c, ITGB1, CD29, ITGB2, CD18, LFA-1, ITGB7, TNFR2, DNAM1 (CD226), SLAMF4 (CD244, 2B4), CD84, CD96 (Tactile), CEACAM1, CRTAM, Ly9 (CD229), CD160 (BY55), PSGL1, CD100 (SEMA4D), SLAMF6 (NTB-A, Ly108), SLAM (SLAMF1, CD150, IPO-3), BLAME (SLAMF8), SELPLG (CD162), LTBR, PAG/Cbp, NKG2D, NKG2C, and CD19.

A transmembrane domain can include one or more additional amino acids adjacent to the transmembrane region, e.g., one or more amino acid associated with the extracellular region of the protein from which the transmembrane was derived (e.g., 1, 2, 3, 4, 5, 6, 7, 8, 9, 10 up to 15 amino acids of the extracellular region) and/or one or more additional amino acids associated with the intracellular region of the protein from which the transmembrane protein is derived (e.g., 1, 2, 3, 4, 5, 6, 7, 8, 9, 10 up to 15 amino acids of the intracellular region). In one aspect, the transmembrane domain is one that is associated with one of the otherdomains of the CAR is used. In some instances, the transmembrane domain can be selected or modified by amino acid substitution to avoid binding of such domains to the transmembrane domains of the same or different surface membrane proteins, e.g., to minimize interactions with other members of the receptor complex. In one aspect, the transmembrane domain is capable of homodimerization with another CAR on the CAR-expressing cell, e.g., CART cell, cell surface. In a different aspect the amino acid sequence of the transmembrane domain may be modified or substituted so as to minimize interactions with the binding domains of the native binding partner present in the same CAR-expressing cell, e.g., CART cell.

In some instances, the transmembrane domain can be attached to the extracellular region of the CAR, e.g., the antigen binding domain of the CAR, via a hinge, e.g., a hinge from a human protein. For example, in one embodiment, the hinge can be a human Ig (immunoglobulin) hinge, e.g., an IgG4 hinge, or a CD8a hinge. In one embodiment, the hinge or spacer comprises (e.g., consists of) the amino acid sequence of SEQ ID NO:2. In one aspect, the transmembrane domain comprises (e.g., consists of) a transmembrane domain of SEQ ID NO: 6.

In one aspect, the hinge or spacer comprises an IgG4 hinge. For example, in one embodiment, the hinge or spacer comprises a hinge of the amino acid sequence SEQ ID NO:3. In some embodiments, the hinge or spacer comprises a hinge encoded by a nucleotide sequence of SEQ ID NO:14.

In one aspect, the hinge or spacer comprises an IgD hinge. For example, in one embodiment, the hinge or spacer comprises a hinge of the amino acid sequence SEQ ID NO:4. In some embodiments, the hinge or spacer comprises a hinge encoded by a nucleotide sequence of SEQ ID NO:15.

In one aspect, the transmembrane domain may be recombinant, in which case it will comprise predominantly hydrophobic residues such as leucine and valine. In one aspect a triplet of phenylalanine, tryptophan and valine can be found at each end of a recombinant transmembrane domain.

Optionally, a short oligo- or polypeptide linker, between 2 and 10 amino acids in length may form the linkage between the transmembrane domain and the cytoplasmic region of the CAR. A glycine-serine doublet provides a particularly suitable linker. For example, in one aspect, the linker comprises the amino acid sequence of SEQ ID NO:5. In some embodiments, the linker is encoded by a nucleotide sequence SEQ ID NO:16.

In one aspect, the hinge or spacer comprises a KIR2DS2 hinge.

Chimeric TCR

In one aspect, an antigen binding domain described herein, e.g., an antibody or antibody fragments described herein, e.g., as provided in Table 4, can be grafted to one or more constant domain of a T cell receptor ("TCR") chain, for example, a TCR alpha or TCR beta chain, to create an chimeric TCR that binds specificity to a desired tumor antigen. Without being bound by theory, it is believed that chimeric TCRs will signal through the TCR complex upon antigen binding. Such chimeric TCRs may be produced by methods known in the art (For example, Willemsen R A et al, Gene Therapy 2000; 7: 1369-1377; Zhang T et al, Cancer Gene Ther 2004; 11: 487-496; Aggen et al, Gene Ther. 2012 April; 19(4):365-74).

In an embodiment, an NKR-CAR-expressing cell described herein, e.g., a KIR-CAR-expressing cell described herein, further comprises a chimeric TCR. In an alternative embodiment, a NKR-CAR-expressing cell described herein is administered in combination with a cell expressing a chimeric TCR. In such embodiments, the antigen binding domain of the chimeric TCR can bind the same tumor antigen as the NKR-CAR described herein, e.g., KIR-CAR, or can bind a different tumor antigen as the NKR-CAR described herein, e.g., KIR-CAR.

Split CAR

In some embodiments, the CAR-expressing cell uses a split CAR. The split CAR approach is described in more detail in publications WO2014/055442 and WO2014/055657, incorporated herein by reference. Briefly, a split CAR system comprises a cell expressing a first CAR having a first antigen binding domain and a costimulatory domain (e.g., 4-1BB), and the cell also expresses a second CAR having a second antigen binding domain and an intracellular signaling domain (e.g., CD3 zeta). When the cell encounters the first antigen, the costimulatory domain is activated, and the cell proliferates. When the cell encounters the second antigen, the intracellular signaling domain is activated and cell-killing activity begins. Thus, the CAR-expressing cell is only fully activated in the presence of both antigens. In embodiments the first antigen binding domain recognizes a tumor antigen described herein, and the second antigen binding domain recognizes a different tumor antigen described herein.

Strategies for Regulating Chimeric Antigen Receptors

There are many ways CAR activities can be regulated. In some embodiments, a regulatable CAR where the CAR activity can be controlled is desirable to optimize the safety and efficacy of a CAR therapy. For example, inducing apoptosis using, e.g., a caspase fused to a dimerization domain (see, e.g., Di et al., N Engl. J. Med. 2011 Nov. 3; 365(18):1673-1683), can be used as a safety switch in the CAR therapy of the instant invention. In another example, CAR-expressing cells can also express an inducible Caspase-9 (iCaspase-9) molecule that, upon administration of a dimerizer drug (e.g., rimiducid (also called AP1903 (Bellicum Pharmaceuticals) or AP20187 (Ariad)) leads to activation of the Caspase-9 and apoptosis of the cells. The iCaspase-9 molecule contains a chemical inducer of dimerization (CID) binding domain that mediates dimerization in the presence of a CID. This results in inducible and selective depletion of CAR-expressing cells. In some cases, the iCaspase-9 molecule is encoded by a nucleic acid molecule separate from the CAR-encoding vector(s). In some cases, the iCaspase-9 molecule is encoded by the same nucleic acid molecule as the CAR-encoding vector. The iCaspase-9 can provide a safety switch to avoid any toxicity of CAR-expressing cells. See, e.g., Song et al. Cancer Gene Ther. 2008; 15(10):667-75; Clinical Trial Id. No. NCT02107963; and Di Stasi et al. N. Engl. J. Med. 2011; 365:1673-83.

Alternative strategies for regulating the CAR therapy of the instant invention include utilizing small molecules or antibodies that deactivate or turn off CAR activity, e.g., by deleting CAR-expressing cells, e.g., by inducing antibody dependent cell-mediated cytotoxicity (ADCC). For example, CAR-expressing cells described herein may also express an antigen that is recognized by molecules capable of inducing cell death, e.g., ADCC or complement-induced cell death. For example, CAR expressing cells described herein may also express a receptor capable of being targeted by an antibody or antibody fragment. Examples of such receptors include EpCAM, VEGFR, integrins (e.g., integrins $\alpha v\beta 3$, $\alpha 4$, $\alpha I\frac{3}{4}\beta 3$, $\alpha 4\beta 7$, $\alpha 5\beta 1$, $\alpha v\beta 3$, $\alpha v$), members of the TNF receptor superfamily (e.g., TRAIL-R1, TRAIL-R2), PDGF Receptor, interferon receptor, folate receptor, GPNMB, ICAM-1, HLA-DR, CEA, CA-125, MUC1, TAG- 72, IL-6 receptor, 5T4, GD2, GD3, CD2, CD3, CD4, CD5, CD11, CD11a/LFA-1, CD15, CD18/ITGB2, CD19, CD20, CD22, CD23/IgE Receptor, CD25, CD28, CD30, CD33, CD38, CD40, CD41, CD44, CD51, CD52, CD62L, CD74, CD80, CD125, CD147/basigin, CD152/CTLA-4, CD154/ CD40L, CD195/CCR5, CD319/SLAMF7, and EGFR, and truncated versions thereof (e.g., versions preserving one or more extracellular epitopes but lacking one or more regions within the cytoplasmic domain).

For example, a CAR-expressing cell described herein may also express a truncated epidermal growth factor receptor (EGFR) which lacks signaling capacity but retains the epitope that is recognized by molecules capable of inducing ADCC, e.g., cetuximab (ERBITUX®), such that administration of cetuximab induces ADCC and subsequent depletion of the CAR-expressing cells (see, e.g., WO2011/056894, and Jonnalagadda et al., Gene Ther. 2013; 20(8) 853-860). Another strategy includes expressing a highly compact marker/suicide gene that combines target epitopes from both CD32 and CD20 antigens in the CAR-expressing cells described herein, which binds rituximab, resulting in selective depletion of the CAR-expressing cells, e.g., by ADCC (see, e.g., Philip et al., Blood. 2014; 124(8)1277-1287). Other methods for depleting CAR-expressing cells described herein include administration of CAMPATH, a monoclonal anti-CD52 antibody that selectively binds and targets mature lymphocytes, e.g., CAR-expressing cells, for destruction, e.g., by inducing ADCC. In other embodiments, the CAR-expressing cell can be selectively targeted using a CAR ligand, e.g., an anti-idiotypic antibody. In some embodiments, the anti-idiotypic antibody can cause effector cell activity, e.g., ADCC or ADC activities, thereby reducing the number of CAR-expressing cells. In other embodiments, the CAR ligand, e.g., the anti-idiotypic antibody, can be coupled to an agent that induces cell killing, e.g., a toxin, thereby reducing the number of CAR-expressing cells. Alternatively, the CAR molecules themselves can be configured such that the activity can be regulated, e.g., turned on and off, as described below.

In other embodiments, a CAR-expressing cell described herein may also express a target protein recognized by the T cell depleting agent. In one embodiment, the target protein is CD20 and the T cell depleting agent is an anti-CD20 antibody, e.g., rituximab. In such embodiment, the T cell depleting agent is administered once it is desirable to reduce or eliminate the CAR-expressing cell, e.g., to mitigate the CAR induced toxicity. In other embodiments, the T cell depleting agent is an anti-CD52 antibody, e.g., alemtuzumab, as described in the Examples herein.

In other embodiments, a regulatable CAR (RCAR) comprises a set of polypeptides, typically two in the simplest embodiments, in which the components of a standard CAR described herein, e.g., an antigen binding domain and an intracellular signaling domain, are partitioned on separate polypeptides or members. In some embodiments, the set of polypeptides include a dimerization switch that, upon the presence of a dimerization molecule, can couple the polypeptides to one another, e.g., can couple an antigen binding domain to an intracellular signaling domain. Additional description and exemplary configurations of such regulatable CARs are provided herein and in International Publication No. WO 2015/090229, hereby incorporated by reference in its entirety.

In an aspect, an RCAR comprises two polypeptides or members: 1) an intracellular signaling member comprising an intracellular signaling domain, e.g., a primary intracellular signaling domain described herein, and a first switch domain; 2) an antigen binding member comprising an antigen binding domain, e.g., that specifically binds a tumor antigen described herein, as described herein and a second switch domain. Optionally, the RCAR comprises a transmembrane domain described herein. In an embodiment, a transmembrane domain can be disposed on the intracellular signaling member, on the antigen binding member, or on both. (Unless otherwise indicated, when members or elements of an RCAR are described herein, the order can be as provided, but other orders are included as well. In other words, in an embodiment, the order is as set out in the text, but in other embodiments, the order can be different. E.g., the order of elements on one side of a transmembrane region can be different from the example, e.g., the placement of a switch domain relative to a intracellular signaling domain can be different, e.g., reversed).

In an embodiment, the first and second switch domains can form an intracellular or an extracellular dimerization switch. In an embodiment, the dimerization switch can be a homodimerization switch, e.g., where the first and second switch domain are the same, or a heterodimerization switch, e.g., where the first and second switch domain are different from one another.

In embodiments, an RCAR can comprise a "multi switch." A multi switch can comprise heterodimerization switch domains or homodimerization switch domains. A multi switch comprises a plurality of, e.g., 2, 3, 4, 5, 6, 7, 8, 9, or 10, switch domains, independently, on a first member, e.g., an antigen binding member, and a second member, e.g., an intracellular signaling member. In an embodiment, the first member can comprise a plurality of first switch domains, e.g., FKBP-based switch domains, and the second member can comprise a plurality of second switch domains, e.g., FRB-based switch domains. In an embodiment, the first member can comprise a first and a second switch domain, e.g., a FKBP-based switch domain and a FRB-based switch domain, and the second member can comprise a first and a second switch domain, e.g., a FKBP-based switch domain and a FRB-based switch domain.

In an embodiment, the intracellular signaling member comprises one or more intracellular signaling domains, e.g., a primary intracellular signaling domain and one or more costimulatory signaling domains.

In an embodiment, the antigen binding member may comprise one or more intracellular signaling domains, e.g., one or more costimulatory signaling domains. In an embodiment, the antigen binding member comprises a plurality, e.g., 2 or 3 costimulatory signaling domains described herein, e.g., selected from 4-1BB, CD28, CD27, ICOS, and OX40, and in embodiments, no primary intracellular signaling domain. In an embodiment, the antigen binding member comprises the following costimulatory signaling domains, from the extracellular to intracellular direction: 4-1BB-CD27; 4-1BB-CD27; CD27-4-1BB; 4-1BB-CD28; CD28-4-1BB; OX40-CD28; CD28-OX40; CD28-4-1BB; or 4-1BB-CD28. In such embodiments, the intracellular binding member comprises a CD3zeta domain. In one such embodiment the RCAR comprises (1) an antigen binding member comprising, an antigen binding domain, a transmembrane domain, and two costimulatory domains and a first switch domain; and (2) an intracellular signaling domain comprising a transmembrane domain or membrane tethering domain and at least one primary intracellular signaling domain, and a second switch domain.

An embodiment provides RCARs wherein the antigen binding member is not tethered to the surface of the CAR cell. This allows a cell having an intracellular signaling member to be conveniently paired with one or more antigen binding domains, without transforming the cell with a sequence that encodes the antigen binding member. In such embodiments, the RCAR comprises: 1) an intracellular signaling member comprising: a first switch domain, a transmembrane domain, an intracellular signaling domain, e.g., a primary intracellular signaling domain, and a first switch domain; and 2) an antigen binding member comprising: an antigen binding domain, and a second switch domain, wherein the antigen binding member does not comprise a transmembrane domain or membrane tethering domain, and, optionally, does not comprise an intracellular signaling domain. In some embodiments, the RCAR may further comprise 3) a second antigen binding member comprising: a second antigen binding domain, e.g., a second antigen binding domain that binds a different antigen than is bound by the antigen binding domain; and a second switch domain.

Also provided herein are RCARs wherein the antigen binding member comprises bispecific activation and targeting capacity. In this embodiment, the antigen binding member can comprise a plurality, e.g., 2, 3, 4, or 5 antigen binding domains, e.g., scFvs, wherein each antigen binding domain binds to a target antigen, e.g. different antigens or the same antigen, e.g., the same or different epitopes on the same antigen. In an embodiment, the plurality of antigen binding domains are in tandem, and optionally, a linker or hinge region is disposed between each of the antigen binding domains. Suitable linkers and hinge regions are described herein.

An embodiment provides RCARs having a configuration that allows switching of proliferation. In this embodiment, the RCAR comprises: 1) an intracellular signaling member comprising: optionally, a transmembrane domain or membrane tethering domain; one or more co-stimulatory signaling domain, e.g., selected from 4-1BB, CD28, CD27, ICOS, and OX40, and a switch domain; and 2) an antigen binding member comprising: an antigen binding domain, a transmembrane domain, and a primary intracellular signaling domain, e.g., a CD3zeta domain, wherein the antigen binding member does not comprise a switch domain, or does not comprise a switch domain that dimerizes with a switch domain on the intracellular signaling member. In an embodiment, the antigen binding member does not comprise a co-stimulatory signaling domain. In an embodiment, the intracellular signaling member comprises a switch domain from a homodimerization switch. In an embodiment, the intracellular signaling member comprises a first switch domain of a heterodimerization switch and the RCAR comprises a second intracellular signaling member which comprises a second switch domain of the heterodimerization switch. In such embodiments, the second intracellular signaling member comprises the same intracellular signaling domains as the intracellular signaling member. In an embodiment, the dimerization switch is intracellular. In an embodiment, the dimerization switch is extracellular.

In any of the RCAR configurations described here, the first and second switch domains comprise a FKBP-FRB based switch as described herein.

Also provided herein are cells comprising an RCAR described herein. Any cell that is engineered to express a RCAR can be used as a RCARX cell. In an embodiment the RCARX cell is a T cell, and is referred to as a RCART cell. In an embodiment the RCARX cell is an NK cell, and is referred to as a RCARN cell.

Also provided herein are nucleic acids and vectors comprising RCAR encoding sequences. Sequence encoding various elements of an RCAR can be disposed on the same nucleic acid molecule, e.g., the same plasmid or vector, e.g., viral vector, e.g., lentiviral vector. In an embodiment, (i) sequence encoding an antigen binding member and (ii) sequence encoding an intracellular signaling member, can be present on the same nucleic acid, e.g., vector. Production of the corresponding proteins can be achieved, e.g., by the use of separate promoters, or by the use of a bicistronic transcription product (which can result in the production of two proteins by cleavage of a single translation product or by the translation of two separate protein products). In an embodiment, a sequence encoding a cleavable peptide, e.g., a P2A or F2A sequence, is disposed between (i) and (ii). In an embodiment, a sequence encoding an IRES, e.g., an EMCV or EV71 IRES, is disposed between (i) and (ii). In these embodiments, (i) and (ii) are transcribed as a single RNA. In an embodiment, a first promoter is operably linked to (i) and a second promoter is operably linked to (ii), such that (i) and (ii) are transcribed as separate mRNAs.

Alternatively, the sequence encoding various elements of an RCAR can be disposed on the different nucleic acid molecules, e.g., different plasmids or vectors, e.g., viral vector, e.g., lentiviral vector. E.g., the (i) sequence encoding an antigen binding member can be present on a first nucleic acid, e.g., a first vector, and the (ii) sequence encoding an intracellular signaling member can be present on the second nucleic acid, e.g., the second vector.

Dimerization Switches

Dimerization switches can be non-covalent or covalent. In a non-covalent dimerization switch, the dimerization molecule promotes a non-covalent interaction between the switch domains. In a covalent dimerization switch, the dimerization molecule promotes a covalent interaction between the switch domains.

In an embodiment, the RCAR comprises a FKBP/FRAP, or FKBP/FRB-based dimerization switch. FKBP12 (FKBP, or FK506 binding protein) is an abundant cytoplasmic protein that serves as the initial intracellular target for the natural product immunosuppressive drug, rapamycin. Rapamycin binds to FKBP and to the large PI3K homolog FRAP (RAFT, mTOR). FRB is a 93 amino acid portion of FRAP, that is sufficient for binding the FKBP-rapamycin complex (Chen, J., Zheng, X. F., Brown, E. J. & Schreiber, S. L. (1995) *Identification of an 11-kDa FKBP12-rapamycin-binding domain within the 289-kDa FKBPJ2-rapamycin-associated protein and characterization of a critical serine residue*. Proc Natl Acad Sci USA 92: 4947-51.)

In embodiments, an FKBP/FRAP, e.g., an FKBP/FRB, based switch can use a dimerization molecule, e.g., rapamycin or a rapamycin analog.

The amino acid sequence of FKBP is as follows:

```
                                       (SEQ ID NO: 43)
D V P D Y A S L G G P S S P K K K R K V S R G V Q

V E T I S P G D G R T F P K R G Q T C V V H Y T G

M L E D G K K F D S S R D R N K P F K F M L G K Q

E V I R G W E E G V A Q M S V G Q R A K L T I S P

D Y A Y G A T G H P G I I P P H A T L V F D V E L

L K L E T S Y
```

In embodiments, an FKBP switch domain can comprise a fragment of FKBP having the ability to bind with FRB, or a fragment or analog thereof, in the presence of rapamycin or a rapalog, e.g., the underlined portion of SEQ ID NO: 43, which is:

```
                                          (SEQ ID NO: 44)
V Q V E T I S P G D G R T F P K R G Q T C V V H Y

T G M L E D G K K F D S S R D R N K P F K F M L G

K Q E V I R G W E E G V A Q M S V G Q R A K L T I

S P D Y A Y G A T G H P G I I P P H A T L V F D V

E L L K L E T S
```

The amino acid sequence of FRB is as follows:

```
                                          (SEQ ID NO: 45)
ILWHEMWHEG LEEASRLYFG ERNVKGMFEV LEPLHAMMER

GPQTLKETSF NQAYGRDLME AQEWCRKYMK SGNVKDLTQA

WDLYYHVFRR ISK
```

"FKBP/FRAP, e.g., an FKBP/FRB, based switch" as that term is used herein, refers to a dimerization switch comprising: a first switch domain, which comprises an FKBP fragment or analog thereof having the ability to bind with FRB, or a fragment or analog thereof, in the presence of rapamycin or a rapalog, e.g., RAD001, and has at least 70, 75, 80, 85, 90, 95, 96, 97, 98, or 99% identity with, or differs by no more than 30, 25, 20, 15, 10, 5, 4, 3, 2, or 1 amino acid residues from, the FKBP sequence of SEQ ID NO: 54 or 55; and a second switch domain, which comprises an FRB fragment or analog thereof having the ability to bind with FRB, or a fragment or analog thereof, in the presence of rapamycin or a rapalog, and has at least 70, 75, 80, 85, 90, 95, 96, 97, 98, or 99% identity with, or differs by no more than 30, 25, 20, 15, 10, 5, 4, 3, 2, or 1 amino acid residues from, the FRB sequence of SEQ ID NO: 45. In an embodiment, a RCAR described herein comprises one switch domain comprises amino acid residues disclosed in SEQ ID NO: 43 (or SEQ ID NO: 44), and one switch domain comprises amino acid residues disclosed in SEQ ID NO: 45.

In embodiments, the FKBP/FRB dimerization switch comprises a modified FRB switch domain that exhibits altered, e.g., enhanced, complex formation between an FRB-based switch domain, e.g., the modified FRB switch domain, a FKBP-based switch domain, and the dimerization molecule, e.g., rapamycin or a rapalogue, e.g., RAD001. In an embodiment, the modified FRB switch domain comprises one or more mutations, e.g., 2, 3, 4, 5, 6, 7, 8, 9, 10 or more, selected from mutations at amino acid position(s) L2031, E2032, S2035, R2036, F2039, G2040, T2098, W2101, D2102, Y2105, and F2108, where the wild-type amino acid is mutated to any other naturally-occurring amino acid. In an embodiment, a mutant FRB comprises a mutation at E2032, where E2032 is mutated to phenylalanine (E2032F), methionine (E2032M), arginine (E2032R), valine (E2032V), tyrosine (E2032Y), isoleucine (E2032I), e.g., SEQ ID NO: 46, or leucine (E2032L), e.g., SEQ ID NO: 47. In an embodiment, a mutant FRB comprises a mutation at T2098, where T2098 is mutated to phenylalanine (T2098F) or leucine (T2098L), e.g., SEQ ID NO: 48. In an embodiment, a mutant FRB comprises a mutation at E2032 and at T2098, where E2032 is mutated to any amino acid, and where T2098 is mutated to any amino acid, e.g., SEQ ID NO: 49. In an embodiment, a mutant FRB comprises an E2032I and a T2098L mutation, e.g., SEQ ID NO: 50. In an embodiment, a mutant FRB comprises an E2032L and a T2098L mutation, e.g., SEQ ID NO: 51.

TABLE 6

Exemplary mutant FRB having increased affinity for a dimerization molecule.

| FRB mutant | Amino Acid Sequence | SEQ ID NO: |
|---|---|---|
| E2032I mutant | ILWHEMWHEGLIEASRLYFGERNVKGMFEVLEPLHAMMERGPQTLKETSFNQAYGRDLMEAQEWCRKYMKSGNVKDLTQAWDLYYHVFRRISKTS | 46 |
| E2032L mutant | ILWHEMWHEGLLEASRLYFGERNVKGMFEVLEPLHAMMERGPQTLKETSFNQAYGRDLMEAQEWCRKYMKSGNVKDLTQAWDLYYHVFRRISKTS | 47 |
| T2098L mutant | ILWHEMWHEGLEEASRLYFGERNVKGMFEVLEPLHAMMERGPQTLKETSFNQAYGRDLMEAQEWCRKYMKSGNVKDLLQAWDLYYHVFRRISKTS | 48 |
| E2032, T2098 mutant | ILWHEMWHEGLXEASRLYFGERNVKGMFEVLEPLHAMMERGPQTLKETSFNQAYGRDLMEAQEWCRKYMKSGNVKDLXQAWDLYYHVFRRISKTS | 49 |
| E2032I, T2098L mutant | ILWHEMWHEGLIEASRLYFGERNVKGMFEVLEPLHAMMERGPQTLKETSFNQAYGRDLMEAQEWCRKYMKSGNVKDLLQAWDLYYHVFRRISKTS | 50 |
| E2032L, T2098L mutant | ILWHEMWHEGLLEASRLYFGERNVKGMFEVLEPLHAMMERGPQTLKETSFNQAYGRDLMEAQEWCRKYMKSGNVKDLLQAWDLYYHVFRRISKTS | 51 |

Other suitable dimerization switches include a GyrB-GyrB based dimerization switch, a Gibberellin-based dimerization switch, a tag/binder dimerization switch, and a halo-tag/snap-tag dimerization switch. Following the guidance provided herein, such switches and relevant dimerization molecules will be apparent to one of ordinary skill.

Dimerization Molecule

Association between the switch domains is promoted by the dimerization molecule. In the presence of dimerization molecule interaction or association between switch domains allows for signal transduction between a polypeptide associated with, e.g., fused to, a first switch domain, and a polypeptide associated with, e.g., fused to, a second switch domain. In the presence of non-limiting levels of dimerization molecule signal transduction is increased by 1.1, 1.2, 1.3, 1.4, 1.5, 1.6, 1.7, 1.8, 1.9, 2, 5, 10, 50, 100 fold, e.g., as measured in a system described herein.

Rapamycin and rapamycin analogs (sometimes referred to as rapalogues), e.g., RAD001, can be used as dimerization molecules in a FKBP/FRB-based dimerization switch described herein. In an embodiment the dimerization molecule can be selected from rapamycin (sirolimus), RAD001 (everolimus), zotarolimus, temsirolimus, AP-23573 (ridaforolimus), biolimus and AP21967. Additional rapamycin analogs suitable for use with FKBP/FRB-based dimerization switches are further described in the section entitled "Combination Therapies", or in the subsection entitled "Combination with a low dose mTOR inhibitor".

Co-Expression of CAR with a Chemokine Receptor

In embodiments, the CAR-expressing cell, e.g., the NKR-CAR-expressing cell, e.g., the KIR-CAR-expressing cell, described herein further comprises a chemokine receptor molecule. Transgenic expression of chemokine receptors CCR2b or CXCR2 in T cells enhances trafficking to CCL2- or CXCL1-secreting solid tumors including melanoma and neuroblastoma (Craddock et al., *J Immunother.* 2010 October; 33(8):780-8 and Kershaw et al., *Hum Gene Ther.* 2002 Nov. 1; 13(16):1971-80). Thus, without wishing to be bound by theory, it is believed that chemokine receptors expressed in CAR-expressing cells that recognize chemokines secreted by tumors, e.g., solid tumors, can improve homing of the CAR-expressing cell to the tumor, facilitate the infiltration of the CAR-expressing cell to the tumor, and enhances antitumor efficacy of the CAR-expressing cell. The chemokine receptor molecule can comprise a naturally occurring or recombinant chemokine receptor or a chemokine-binding fragment thereof. A chemokine receptor molecule suitable for expression in a CAR-expressing cell described herein include a CXC chemokine receptor (e.g., CXCR1, CXCR2, CXCR3, CXCR4, CXCR5, CXCR6, or CXCR7), a CC chemokine receptor (e.g., CCR1, CCR2, CCR3, CCR4, CCR5, CCR6, CCR7, CCR8, CCR9, CCR10, or CCR11), a CX3C chemokine receptor (e.g., CX3CR1), a XC chemokine receptor (e.g., XCR1), or a chemokine-binding fragment thereof. In one embodiment, the chemokine receptor molecule to be expressed with a CAR described herein is selected based on the chemokine(s) secreted by the tumor. In one embodiment, the CAR-expressing cell described herein further comprises, e.g., expresses, a CCR2b receptor or a CXCR2 receptor. In an embodiment, the CAR described herein and the chemokine receptor molecule are on the same vector or are on two different vectors. In embodiments where the CAR described herein and the chemokine receptor molecule are on the same vector, the CAR and the chemokine receptor molecule are each under control of two different promoters or are under the control of the same promoter.

Nucleic Acid Constructs Encoding a CAR

The present invention also provides nucleic acid molecules encoding one or more CAR constructs described herein. In one aspect, the nucleic acid molecule is provided as a messenger RNA transcript. In one aspect, the nucleic acid molecule is provided as a DNA construct.

In an embodiment, the nucleic acid molecule encoding a NKR-CAR described herein further comprises a nucleic acid sequence encoding an intracellular signaling domain or adaptor molecule.

The present invention also provides vectors in which a DNA of the present invention is inserted. Vectors derived from retroviruses such as the lentivirus are suitable tools to achieve long-term gene transfer since they allow long-term, stable integration of a transgene and its propagation in daughter cells. Lentiviral vectors have the added advantage over vectors derived from onco-retroviruses such as murine leukemia viruses in that they can transduce non-proliferating cells, such as hepatocytes. They also have the added advantage of low immunogenicity. A retroviral vector may also be, e.g., a gammaretroviral vector. A gammaretroviral vector may include, e.g., a promoter, a packaging signal ($\psi$), a primer binding site (PBS), one or more (e.g., two) long terminal repeats (LTR), and a transgene of interest, e.g., a gene encoding a CAR. A gammaretroviral vector may lack viral structural gens such as gag, pol, and env. Exemplary gammaretroviral vectors include Murine Leukemia Virus (MLV), Spleen-Focus Forming Virus (SFFV), and Myeloproliferative Sarcoma Virus (MPSV), and vectors derived therefrom. Other gammaretroviral vectors are described, e.g., in Tobias Maetzig et al., "Gammaretroviral Vectors: Biology, Technology and Application" Viruses. 2011 June; 3(6): 677-713.

In another embodiment, the vector comprising the nucleic acid encoding the desired CAR of the invention is an adenoviral vector (A5/35). In another embodiment, the expression of nucleic acids encoding CARs can be accomplished using of transposons such as sleeping beauty, crisper, CAS9, and zinc finger nucleases. See below June et al. 2009 *Nature Reviews Immunology* 9.10: 704-716, is incorporated herein by reference.

In brief summary, the expression of natural or synthetic nucleic acids encoding CARs is typically achieved by operably linking a nucleic acid encoding the CAR polypeptide or portions thereof to a promoter, and incorporating the construct into an expression vector. The vectors can be suitable for replication and integration eukaryotes. Typical cloning vectors contain transcription and translation terminators, initiation sequences, and promoters useful for regulation of the expression of the desired nucleic acid sequence.

The expression constructs of the present invention may also be used for nucleic acid immunization and gene therapy, using standard gene delivery protocols. Methods for gene delivery are known in the art. See, e.g., U.S. Pat. Nos. 5,399,346, 5,580,859, 5,589,466, incorporated by reference herein in their entireties. In another embodiment, the invention provides a gene therapy vector.

The nucleic acid can be cloned into a number of types of vectors. For example, the nucleic acid can be cloned into a vector including, but not limited to a plasmid, a phagemid, a phage derivative, an animal virus, and a cosmid. Vectors of particular interest include expression vectors, replication vectors, probe generation vectors, and sequencing vectors.

Further, the expression vector may be provided to a cell in the form of a viral vector. Viral vector technology is well known in the art and is described, for example, in Sambrook et al., 2012, MOLECULAR CLONING: A LABORATORY MANUAL, volumes 1-4, Cold Spring Harbor Press, NY), and in other virology and molecular biology manuals. Viruses, which are useful as vectors include, but are not limited to, retroviruses, adenoviruses, adeno-associated viruses, herpes viruses, and lentiviruses. In general, a suitable vector contains an origin of replication functional in at least one organism, a promoter sequence, convenient restriction endonuclease sites, and one or more selectable markers, (e.g., WO 01/96584; WO 01/29058; and U.S. Pat. No. 6,326,193).

A number of viral based systems have been developed for gene transfer into mammalian cells. For example, retroviruses provide a convenient platform for gene delivery systems. A selected gene can be inserted into a vector and packaged in retroviral particles using techniques known in the art. The recombinant virus can then be isolated and delivered to cells of the subject either in vivo or ex vivo. A number of retroviral systems are known in the art. In some embodiments, adenovirus vectors are used. A number of adenovirus vectors are known in the art. In one embodiment, lentivirus vectors are used.

Additional promoter elements, e.g., enhancers, regulate the frequency of transcriptional initiation. Typically, these are located in the region 30-110 bp upstream of the start site, although a number of promoters have recently been shown to contain functional elements downstream of the start site as well. The spacing between promoter elements frequently is flexible, so that promoter function is preserved when elements are inverted or moved relative to one another. In the thymidine kinase (tk) promoter, the spacing between promoter elements can be increased to 50 bp apart before activity begins to decline. Depending on the promoter, it appears that individual elements can function either cooperatively or independently to activate transcription.

An example of a promoter that is capable of expressing a CAR transgene in a mammalian T cell is the EF1a promoter. The native EF1a promoter drives expression of the alpha subunit of the elongation factor-1 complex, which is responsible for the enzymatic delivery of aminoacyl tRNAs to the ribosome. The EF1a promoter has been extensively used in mammalian expression plasmids and has been shown to be effective in driving CAR expression from transgenes cloned into a lentiviral vector. See, e.g., Milone et al., Mol. Ther. 17(8): 1453-1464 (2009). In one aspect, the EF1a promoter comprises the sequence provided as SEQ ID NO:11.

An example of a promoter is the immediate early cytomegalovirus (CMV) promoter sequence. This promoter sequence is a strong constitutive promoter sequence capable of driving high levels of expression of any polynucleotide sequence operatively linked thereto. However, other constitutive promoter sequences may also be used, including, but not limited to the simian virus 40 (SV40) early promoter, mouse mammary tumor virus (MMTV), human immunodeficiency virus (HIV) long terminal repeat (LTR) promoter, MoMuLV promoter, an avian leukemia virus promoter, an Epstein-Barr virus immediate early promoter, a Rous sarcoma virus promoter, the elongation factor-1α promoter, as well as human gene promoters such as, but not limited to, the actin promoter, the myosin promoter, the hemoglobin promoter, and the creatine kinase promoter. Further, the invention should not be limited to the use of constitutive promoters. Inducible promoters are also contemplated as part of the invention. The use of an inducible promoter provides a molecular switch capable of turning on expression of the polynucleotide sequence which it is operatively linked when such expression is desired, or turning off the expression when expression is not desired. Examples of inducible promoters include, but are not limited to a metallothionine promoter, a glucocorticoid promoter, a progesterone promoter, and a tetracycline promoter.

In one embodiment, the vector is a lentivirus vector. In one embodiment, the vector further comprises a promoter. In one embodiment, the promoter is an EF-1 promoter.

In one embodiment, the vector is an in vitro transcribed vector, e.g., a vector that transcribes RNA of a nucleic acid molecule described herein. In one embodiment, the nucleic acid sequence in the vector further comprises a poly(A) tail, e.g., a poly A tail described herein, e.g., comprising about 150 adenosine bases. In one embodiment, the nucleic acid sequence in the vector further comprises a 3'UTR.

Another example of a promoter is the phosphoglycerate kinase (PGK) promoter. In embodiments, a truncated PGK promoter (e.g., a PGK promoter with one or more, e.g., 1, 2, 5, 10, 100, 200, 300, or 400, nucleotide deletions when compared to the wild-type PGK promoter sequence) may be desired. The nucleotide sequences of exemplary PGK promoters are provided below.

```
WT PGK Promoter
                                      (SEQ ID NO: 52)
ACCCCTCTCTCCAGCCACTAAGCCAGTTGCTCCCTCGGCTGACGGCTGCA

CGCGAGGCCTCCGAACGTCTTACGCCTTGTGGCGCGCCCGTCCTTGTCCC

GGGTGTGATGGCGGGGTGTGGGCGGAGGGCGTGGCGGGGAAGGGCCGGC

GACGAGAGCCGCGCGGGACGACTCGTCGGCGATAACCGGTGTCGGGTAGC

GCCAGCCGCGCGACGGTAACGAGGGACCGCGACAGGCAGACGCTCCCATG

ATCACTCTGCACGCCGAAGGCAAATAGTGCAGGCCGTGCGGCGCTTGGCG

TTCCTTGGAAGGGCTGAATCCCCGCCTCGTCCTTCGCAGCGGCCCCCCGG

GTGTTCCCATCGCCGCTTCTAGGCCCACTGCGACGCTTGCCTGCACTTCT

TACACGCTCTGGGTCCCAGCCGCGGCGACGCAAAGGGCCTTGGTGCGGGT

CTCGTCGGCGCAGGGACGCGTTTGGGTCCCGACGGAACCTTTTCCGCGTT

GGGGTTGGGGCACCATAAGCT

Exemplary truncated PGK Promoters:
PGK100:
                                      (SEQ ID NO: 53)
ACCCCTCTCTCCAGCCACTAAGCCAGTTGCTCCCTCGGCTGACGGCTGCA

CGCGAGGCCTCCGAACGTCTTACGCCTTGTGGCGCGCCCGTCCTTGTCCC

GGGTGTGATGGCGGGGTG

PGK200:
                                      (SEQ ID NO: 54)
ACCCCTCTCTCCAGCCACTAAGCCAGTTGCTCCCTCGGCTGACGGCTGCA

CGCGAGGCCTCCGAACGTCTTACGCCTTGTGGCGCGCCCGTCCTTGTCCC

GGGTGTGATGGCGGGGTGTGGGCGGAGGGCGTGGCGGGGAAGGGCCGGC

GACGAGAGCCGCGCGGGACGACTCGTCGGCGATAACCGGTGTCGGGTAGC

GCCAGCCGCGCGACGGTAACG

PGK300:
                                      (SEQ ID NO: 55)
ACCCCTCTCTCCAGCCACTAAGCCAGTTGCTCCCTCGGCTGACGGCTGCA

CGCGAGGCCTCCGAACGTCTTACGCCTTGTGGCGCGCCCGTCCTTGTCCC

GGGTGTGATGGCGGGGTGTGGGCGGAGGGCGTGGCGGGGAAGGGCCGGC

GACGAGAGCCGCGCGGGACGACTCGTCGGCGATAACCGGTGTCGGGTAGC

GCCAGCCGCGCGACGGTAACGAGGGACCGCGACAGGCAGACGCTCCCATG

ATCACTCTGCACGCCGAAGGCAAATAGTGCAGGCCGTGCGGCGCTTGGCG

TTCCTTGGAAGGGCTGAATCCCCG
```

PGK400:

(SEQ ID NO: 56)
ACCCCTCTCTCCAGCCACTAAGCCAGTTGCTCCCTCGGCTGACGGCTGCA

CGCGAGGCCTCCGAACGTCTTACGCCTTGTGGCGCGCCCGTCCTTGTCCC

GGGTGTGATGGCGGGGTGTGGGGCGGAGGGCGTGGCGGGGAAGGGCCGGC

GACGAGAGCCGCGCGGGACGACTCGTCGGCGATAACCGGTGTCGGGTAGC

GCCAGCCGCGCGACGGTAACGAGGGACCGCGACAGGCAGACGCTCCCATG

ATCACTCTGCACGCCGAAGGCAAATAGTGCAGGCCGTGCGGCGCTTGGCG

TTCCTTGGAAGGGCTGAATCCCCGCCTCGTCCTTCGCAGCGGCCCCCCGG

GTGTTCCCATCGCCGCTTCTAGGCCCACTGCGACGCTTGCCTGCACTTCT

TACACGCTCTGGGTCCCAGCCG

A vector may also include, e.g., a signal sequence to facilitate secretion, a polyadenylation signal and transcription terminator (e.g., from Bovine Growth Hormone (BGH) gene), an element allowing episomal replication and replication in prokaryotes (e.g. SV40 origin and ColE1 or others known in the art) and/or elements to allow selection (e.g., ampicillin resistance gene and/or zeocin marker).

In order to assess the expression of a CAR polypeptide or portions thereof, the expression vector to be introduced into a cell can also contain either a selectable marker gene or a reporter gene or both to facilitate identification and selection of expressing cells from the population of cells sought to be transfected or infected through viral vectors. In other aspects, the selectable marker may be carried on a separate piece of DNA and used in a co-transfection procedure. Both selectable markers and reporter genes may be flanked with appropriate regulatory sequences to enable expression in the host cells. Useful selectable markers include, for example, antibiotic-resistance genes, such as neo and the like.

Reporter genes are used for identifying potentially transfected cells and for evaluating the functionality of regulatory sequences. In general, a reporter gene is a gene that is not present in or expressed by the recipient organism or tissue and that encodes a polypeptide whose expression is manifested by some easily detectable property, e.g., enzymatic activity. Expression of the reporter gene is assayed at a suitable time after the DNA has been introduced into the recipient cells. Suitable reporter genes may include genes encoding luciferase, beta-galactosidase, chloramphenicol acetyl transferase, secreted alkaline phosphatase, or the green fluorescent protein gene (e.g., Ui-Tei et al., 2000 FEBS Letters 479: 79-82). Suitable expression systems are well known and may be prepared using known techniques or obtained commercially. In general, the construct with the minimal 5' flanking region showing the highest level of expression of reporter gene is identified as the promoter. Such promoter regions may be linked to a reporter gene and used to evaluate agents for the ability to modulate promoter-driven transcription.

In one embodiment, the vector can further comprise a nucleic acid encoding a second CAR, e.g., a second NKR-CAR, a TCAR, or an inhibitory CAR. In one embodiment, the second CAR includes an antigen binding domain that binds to a target antigen, e.g., a tumor antigen described herein. In embodiments, the antigen bound by the first CAR is the same antigen as that bound by the second CAR. Alternatively, the antigen bound by the first CAR is a different antigen to that bound by the second CAR. For example, the first CAR binds to mesothelin, while the second CAR binds to a different tumor antigen or an antigen present on a normal cell.

In one embodiment, the vector comprises a nucleic acid encoding a NKR-CAR described herein and a nucleic acid encoding a TCAR. In one embodiment, the TCAR comprises an antigen binding domain that binds a tumor antigen, e.g., a different tumor antigen that is bound by the NKR-CAR. In one embodiment, the TCAR comprises the antigen binding domain, a transmembrane domain and an intracellular signaling domain, wherein the intracellular signaling domain comprises a primary intracellular signaling domain described herein, e.g., CD3zeta or provided in Table 2, and optionally, one or more costimulatory signaling domains described herein, e.g., 4-1BB, CD28, CD27, ICOS, or provided in Table 3.

In one embodiment, the vector comprises a nucleic acid encoding a NKR-CAR described herein and a nucleic acid encoding an inhibitory CAR. In one embodiment, the inhibitory CAR comprises an antigen binding domain that binds an antigen found on normal cells but not cancer cells, e.g., normal cells that also express the antigen recognized by the NKR-CAR. In one embodiment, the inhibitory CAR comprises the antigen binding domain, a transmembrane domain and an intracellular domain of an inhibitory molecule. For example, the intracellular domain of the inhibitory CAR can be an intracellular domain of PD1, PD-L1, PD-L2, CTLA4, TIM3, CEACAM (e.g., CEACAM-1, CEACAM-3 and/or CEACAM-5), LAG3, VISTA, BTLA, TIGIT, LAIR1, CD160, 2B4, CD80, CD86, B7-H3 (CD276), B7-H4 (VTCN1), HVEM (TNFRSF14 or CD270), KIR, A2aR, MHC class I, MHC class II, GAL9, adenosine, and TGFR beta.

In embodiments, the vector may comprise two or more nucleic acid sequences encoding a CAR, e.g., a NKR-CAR described herein and a second CAR, e.g., a second NKR-CAR, an inhibitory CAR, or a TCAR that specifically binds to an antigen other than the antigen recognized by the first NKR-CAR. In such embodiments, the two or more nucleic acid sequences encoding the CAR are encoded by a single nucleic molecule in the same frame and as a single polypeptide chain. In this aspect, the two or more CARs, can, e.g., be separated by one or more peptide cleavage sites (e.g., an auto-cleavage site or a substrate for an intracellular protease).

In embodiments, the vector comprising a nucleic acid sequence encoding a NKR-CAR described can further comprise a nucleic acid sequence encoding an adaptor molecule. In such embodiments, the two or more nucleic acid sequences are encoded by a single nucleic molecule in the same frame and as a single polypeptide chain. In this embodiment, the NKR-CAR and the adaptor molecule can be separated by one or more peptide cleavage sites (e.g., an auto-cleavage site or a substrate for an intracellular protease), wherein the NKR-CAR, the adaptor molecule, and the peptide cleavage site are in the same frame and are encoded as a single polypeptide chain.

Examples of peptide cleavage sites include the following, wherein the GSG residues are optional:

T2A:
(SEQ ID NO: 57)
(GSG) E G R G S L L T C G D V E E N P G P

-continued

P2A:
(SEQ ID NO: 58)
(GSG) A T N F S L L K Q A G D V E E N P G P

E2A:
(SEQ ID NO: 59)
(GSG) Q C T N Y A L L K L A G D V E S N P G P

F2A:
(SEQ ID NO: 60)
(GSG) V K Q T L N F D L L K L A G D V E S N P G P

Methods of introducing and expressing genes into a cell are known in the art. In the context of an expression vector, the vector can be readily introduced into a host cell, e.g., mammalian, bacterial, yeast, or insect cell by any method in the art. For example, the expression vector can be transferred into a host cell by physical, chemical, or biological means.

Polynucleotides can be introduced into target cells using any of a number of different methods, for instance, commercially available methods which include, but are not limited to, electroporation (Amaxa Nucleofector-II (Amaxa Biosystems, Cologne, Germany)), (ECM 830 (BTX) (Harvard Instruments, Boston, Mass.) or the Gene Pulser II (BioRad, Denver, Colo.), Multiporator (Eppendort, Hamburg Germany), cationic liposome mediated transfection using lipofection, polymer encapsulation, peptide mediated transfection, or biolistic particle delivery systems such as "gene guns" (see, for example, Nishikawa, et al. Hum Gene Ther., 12(8):861-70 (2001).

Physical methods for introducing a polynucleotide into a host cell include calcium phosphate precipitation, lipofection, particle bombardment, microinjection, electroporation, and the like. Methods for producing cells comprising vectors and/or exogenous nucleic acids are well-known in the art. See, for example, Sambrook et al., 2012, MOLECULAR CLONING: A LABORATORY MANUAL, volumes 1-4, Cold Spring Harbor Press, NY).

Biological methods for introducing a polynucleotide of interest into a host cell include the use of DNA and RNA vectors. Viral vectors, and especially retroviral vectors, have become the most widely used method for inserting genes into mammalian, e.g., human cells. Other viral vectors can be derived from lentivirus, poxviruses, herpes simplex virus I, adenoviruses and adeno-associated viruses, and the like. See, for example, U.S. Pat. Nos. 5,350,674 and 5,585,362.

Chemical means for introducing a polynucleotide into a host cell include colloidal dispersion systems, such as macromolecule complexes, nanocapsules, microspheres, beads, and lipid-based systems including oil-in-water emulsions, micelles, mixed micelles, and liposomes. An exemplary colloidal system for use as a delivery vehicle in vitro and in vivo is a liposome (e.g., an artificial membrane vesicle).

In the case where a non-viral delivery system is utilized, an exemplary delivery vehicle is a liposome. The use of lipid formulations is contemplated for the introduction of the nucleic acids into a host cell (in vitro, ex vivo or in vivo). In another aspect, the nucleic acid may be associated with a lipid. The nucleic acid associated with a lipid may be encapsulated in the aqueous interior of a liposome, interspersed within the lipid bilayer of a liposome, attached to a liposome via a linking molecule that is associated with both the liposome and the oligonucleotide, entrapped in a liposome, complexed with a liposome, dispersed in a solution containing a lipid, mixed with a lipid, combined with a lipid, contained as a suspension in a lipid, contained or complexed with a micelle, or otherwise associated with a lipid. Lipid, lipid/DNA or lipid/expression vector associated compositions are not limited to any particular structure in solution. For example, they may be present in a bilayer structure, as micelles, or with a "collapsed" structure. They may also simply be interspersed in a solution, possibly forming aggregates that are not uniform in size or shape. Lipids are fatty substances which may be naturally occurring or synthetic lipids. For example, lipids include the fatty droplets that naturally occur in the cytoplasm as well as the class of compounds which contain long-chain aliphatic hydrocarbons and their derivatives, such as fatty acids, alcohols, amines, amino alcohols, and aldehydes. In the case where a non-viral delivery system is utilized, an exemplary delivery vehicle is a liposome. The use of lipid formulations is contemplated for the introduction of the nucleic acids into a host cell (in vitro, ex vivo or in vivo). In another aspect, the nucleic acid may be associated with a lipid. The nucleic acid associated with a lipid may be encapsulated in the aqueous interior of a liposome, interspersed within the lipid bilayer of a liposome, attached to a liposome via a linking molecule that is associated with both the liposome and the oligonucleotide, entrapped in a liposome, complexed with a liposome, dispersed in a solution containing a lipid, mixed with a lipid, combined with a lipid, contained as a suspension in a lipid, contained or complexed with a micelle, or otherwise associated with a lipid. Lipid, lipid/DNA or lipid/expression vector associated compositions are not limited to any particular structure in solution. For example, they may be present in a bilayer structure, as micelles, or with a "collapsed" structure. They may also simply be interspersed in a solution, possibly forming aggregates that are not uniform in size or shape. Lipids are fatty substances which may be naturally occurring or synthetic lipids. For example, lipids include the fatty droplets that naturally occur in the cytoplasm as well as the class of compounds which contain long-chain aliphatic hydrocarbons and their derivatives, such as fatty acids, alcohols, amines, amino alcohols, and aldehydes.

Lipids suitable for use can be obtained from commercial sources. For example, dimyristyl phosphatidylcholine ("DMPC") can be obtained from Sigma, St. Louis, Mo.; dicetyl phosphate ("DCP") can be obtained from K & K Laboratories (Plainview, N.Y.); cholesterol ("Choi") can be obtained from Calbiochem-Behring; dimyristyl phosphatidylglycerol ("DMPG") and other lipids may be obtained from Avanti Polar Lipids, Inc. (Birmingham, Ala.). Stock solutions of lipids in chloroform or chloroform/methanol can be stored at about −20° C. Chloroform is used as the only solvent since it is more readily evaporated than methanol. "Liposome" is a generic term encompassing a variety of single and multilamellar lipid vehicles formed by the generation of enclosed lipid bilayers or aggregates. Liposomes can be characterized as having vesicular structures with a phospholipid bilayer membrane and an inner aqueous medium. Multilamellar liposomes have multiple lipid layers separated by aqueous medium. They form spontaneously when phospholipids are suspended in an excess of aqueous solution. The lipid components undergo self-rearrangement before the formation of closed structures and entrap water and dissolved solutes between the lipid bilayers (Ghosh et al., 1991 Glycobiology 5: 505-10). However, compositions that have different structures in solution than the normal vesicular structure are also encompassed. For example, the lipids may assume a micellar structure or merely exist as nonuniform aggregates of lipid molecules. Also contemplated are lipofectamine-nucleic acid complexes.

Regardless of the method used to introduce exogenous nucleic acids into a host cell or otherwise expose a cell to the inhibitor of the present invention, in order to confirm the presence of the recombinant DNA sequence in the host cell, a variety of assays may be performed. Such assays include, for example, "molecular biological" assays well known to those of skill in the art, such as Southern and Northern blotting, RT-PCR and PCR; "biochemical" assays, such as detecting the presence or absence of a particular peptide, e.g., by immunological means (ELISAs and Western blots) or by assays described herein to identify agents falling within the scope of the invention.

The present invention further provides a vector comprising a CAR encoding nucleic acid molecule. In one aspect, a CAR vector can be directly transduced into a cell, e.g., an immune effector cell, e.g., a T cell or NK cell. In one aspect, the vector is a cloning or expression vector, e.g., a vector including, but not limited to, one or more plasmids (e.g., expression plasmids, cloning vectors, minicircles, minivectors, double minute chromosomes), retroviral and lentiviral vector constructs. In one aspect, the vector is capable of expressing the CAR construct in mammalian immune effector cells, e.g., mammalian T cells or mammalian NK cells. In one aspect, the mammalian T cell is a human T cell.

RNA Transfection

Disclosed herein are methods for producing an in vitro transcribed RNA CAR, e.g., a RNA NKR-CAR. The present invention also includes an NKR-CAR encoding RNA construct that can be directly transfected into a cell. In one embodiment, the NKR-CAR encoding RNA construct further comprises a nucleic acid sequence that encodes a TCAR described herein. A method for generating mRNA for use in transfection can involve in vitro transcription (IVT) of a template with specially designed primers, followed by polyA addition, to produce a construct containing 3' and 5' untranslated sequence ("UTR"), a 5' cap and/or Internal Ribosome Entry Site (IRES), the nucleic acid to be expressed, and a polyA tail, typically 50-2000 bases in length (SEQ ID NO: 35). RNA so produced can efficiently transfect different kinds of cells. In one aspect, the template includes sequences for the NKR-CAR.

In one aspect the NKR-CAR is encoded by a messenger RNA (mRNA). In one aspect the mRNA encoding the NKR-CAR is introduced into a T cell for production of a NKR-CAR cell. In one aspect the mRNA encoding the NKR-CAR is introduced into a NK cell for production of a NKR-CAR cell.

In one embodiment, the in vitro transcribed RNA NKR-CAR can be introduced to a cell as a form of transient transfection. The RNA is produced by in vitro transcription using a polymerase chain reaction (PCR)-generated template. DNA of interest from any source can be directly converted by PCR into a template for in vitro mRNA synthesis using appropriate primers and RNA polymerase. The source of the DNA can be, for example, genomic DNA, plasmid DNA, phage DNA, cDNA, synthetic DNA sequence or any other appropriate source of DNA. In one embodiment, the desired template for in vitro transcription is a NKR-CAR of the present invention. For example, the template for the RNA NKR-CAR comprises an extracellular region comprising a single chain variable domain of an anti-tumor antibody; a hinge region, a transmembrane domain (e.g., a transmembrane domain of KIR). In one embodiment, the desired template for in vitro transcription comprises KIR-CAR and DAP12 on separate templates. In one embodiment, the desired temple for in vitro transcription comprises KIR-CAR and DAP12 on the same template.

The template for DAP12 comprises a transmembrane domain and an intracellular region.

In one embodiment, the DNA to be used for PCR contains an open reading frame. The DNA can be from a naturally occurring DNA sequence from the genome of an organism. In one embodiment, the nucleic acid can include some or all of the 5' and/or 3' untranslated regions (UTRs). The nucleic acid can include exons and introns. In one embodiment, the DNA to be used for PCR is a human nucleic acid sequence. In another embodiment, the DNA to be used for PCR is a human nucleic acid sequence including the 5' and 3' UTRs. The DNA can alternatively be an artificial DNA sequence that is not normally expressed in a naturally occurring organism. An exemplary artificial DNA sequence is one that contains portions of genes that are ligated together to form an open reading frame that encodes a fusion protein. The portions of DNA that are ligated together can be from a single organism or from more than one organism.

PCR is used to generate a template for in vitro transcription of mRNA which is used for transfection. Methods for performing PCR are well known in the art. Primers for use in PCR are designed to have regions that are substantially complementary to regions of the DNA to be used as a template for the PCR. "Substantially complementary," as used herein, refers to sequences of nucleotides where a majority or all of the bases in the primer sequence are complementary, or one or more bases are non-complementary, or mismatched. Substantially complementary sequences are able to anneal or hybridize with the intended DNA target under annealing conditions used for PCR. The primers can be designed to be substantially complementary to any portion of the DNA template. For example, the primers can be designed to amplify the portion of a nucleic acid that is normally transcribed in cells (the open reading frame), including 5' and 3' UTRs. The primers can also be designed to amplify a portion of a nucleic acid that encodes a particular domain of interest. In one embodiment, the primers are designed to amplify the coding region of a human cDNA, including all or portions of the 5' and 3' UTRs. Primers useful for PCR can be generated by synthetic methods that are well known in the art. "Forward primers" are primers that contain a region of nucleotides that are substantially complementary to nucleotides on the DNA template that are upstream of the DNA sequence that is to be amplified. "Upstream" is used herein to refer to a location 5, to the DNA sequence to be amplified relative to the coding strand. "Reverse primers" are primers that contain a region of nucleotides that are substantially complementary to a double-stranded DNA template that are downstream of the DNA sequence that is to be amplified. "Downstream" is used herein to refer to a location 3' to the DNA sequence to be amplified relative to the coding strand.

Any DNA polymerase useful for PCR can be used in the methods disclosed herein. The reagents and polymerase are commercially available from a number of sources.

Chemical structures with the ability to promote stability and/or translation efficiency may also be used. The RNA preferably has 5' and 3' UTRs. In one embodiment, the 5' UTR is between one and 3000 nucleotides in length. The length of 5' and 3' UTR sequences to be added to the coding region can be altered by different methods, including, but not limited to, designing primers for PCR that anneal to different regions of the UTRs. Using this approach, one of ordinary skill in the art can modify the 5' and 3' UTR lengths required to achieve optimal translation efficiency following transfection of the transcribed RNA.

The 5' and 3' UTRs can be the naturally occurring, endogenous 5' and 3' UTRs for the nucleic acid of interest. Alternatively, UTR sequences that are not endogenous to the nucleic acid of interest can be added by incorporating the UTR sequences into the forward and reverse primers or by any other modifications of the template. The use of UTR sequences that are not endogenous to the nucleic acid of interest can be useful for modifying the stability and/or translation efficiency of the RNA. For example, it is known that AU-rich elements in 3' UTR sequences can decrease the stability of mRNA. Therefore, 3' UTRs can be selected or designed to increase the stability of the transcribed RNA based on properties of UTRs that are well known in the art.

In one embodiment, the 5' UTR can contain the Kozak sequence of the endogenous nucleic acid. Alternatively, when a 5' UTR that is not endogenous to the nucleic acid of interest is being added by PCR as described above, a consensus Kozak sequence can be redesigned by adding the 5' UTR sequence. Kozak sequences can increase the efficiency of translation of some RNA transcripts, but does not appear to be required for all RNAs to enable efficient translation. The requirement for Kozak sequences for many mRNAs is known in the art. In other embodiments the 5' UTR can be 5'UTR of an RNA virus whose RNA genome is stable in cells. In other embodiments various nucleotide analogues can be used in the 3' or 5' UTR to impede exonuclease degradation of the mRNA.

To enable synthesis of RNA from a DNA template without the need for gene cloning, a promoter of transcription should be attached to the DNA template upstream of the sequence to be transcribed. When a sequence that functions as a promoter for an RNA polymerase is added to the 5' end of the forward primer, the RNA polymerase promoter becomes incorporated into the PCR product upstream of the open reading frame that is to be transcribed. In one preferred embodiment, the promoter is a T7 polymerase promoter, as described elsewhere herein. Other useful promoters include, but are not limited to, T3 and SP6 RNA polymerase promoters. Consensus nucleotide sequences for T7, T3 and SP6 promoters are known in the art.

In a preferred embodiment, the mRNA has both a cap on the 5' end and a 3' poly(A) tail which determine ribosome binding, initiation of translation and stability mRNA in the cell. On a circular DNA template, for instance, plasmid DNA, RNA polymerase produces a long concatameric product which is not suitable for expression in eukaryotic cells. The transcription of plasmid DNA linearized at the end of the 3' UTR results in normal sized mRNA which is not effective in eukaryotic transfection even if it is polyadenylated after transcription.

On a linear DNA template, phage T7 RNA polymerase can extend the 3' end of the transcript beyond the last base of the template (Schenborn and Mierendorf, Nuc Acids Res., 13:6223-36 (1985); Nacheva and Berzal-Herranz, Eur. J. Biochem., 270:1485-65 (2003).

The conventional method of integration of polyA/T stretches into a DNA template is molecular cloning. However polyA/T sequence integrated into plasmid DNA can cause plasmid instability, which is why plasmid DNA templates obtained from bacterial cells are often highly contaminated with deletions and other aberrations. This makes cloning procedures not only laborious and time consuming but often not reliable. That is why a method which allows construction of DNA templates with polyA/T 3' stretch without cloning highly desirable.

The polyA/T segment of the transcriptional DNA template can be produced during PCR by using a reverse primer containing a polyT tail, such as 100T tail (SEQ ID NO: 31) (size can be 50-5000 T (SEQ ID NO: 32)), or after PCR by any other method, including, but not limited to, DNA ligation or in vitro recombination. Poly(A) tails also provide stability to RNAs and reduce their degradation. Generally, the length of a poly(A) tail positively correlates with the stability of the transcribed RNA. In one embodiment, the poly(A) tail is between 100 and 5000 adenosines (SEQ ID NO: 33).

Poly(A) tails of RNAs can be further extended following in vitro transcription with the use of a poly(A) polymerase, such as E. coli polyA polymerase (E-PAP). In one embodiment, increasing the length of a poly(A) tail from 100 nucleotides to between 300 and 400 nucleotides (SEQ ID NO: 34) results in about a two-fold increase in the translation efficiency of the RNA. Additionally, the attachment of different chemical groups to the 3' end can increase mRNA stability. Such attachment can contain modified/artificial nucleotides, aptamers and other compounds. For example, ATP analogs can be incorporated into the poly(A) tail using poly(A) polymerase. ATP analogs can further increase the stability of the RNA.

5' caps on also provide stability to RNA molecules. In a preferred embodiment, RNAs produced by the methods disclosed herein include a 5' cap. The 5' cap is provided using techniques known in the art and described herein (Cougot, et al., Trends in Biochem. Sci., 29:436-444 (2001); Stepinski, et al., RNA, 7:1468-95 (2001); Elango, et al., Biochim. Biophys. Res. Commun., 330:958-966 (2005)).

The RNAs produced by the methods disclosed herein can also contain an internal ribosome entry site (IRES) sequence. The IRES sequence may be any viral, chromosomal or artificially designed sequence which initiates cap-independent ribosome binding to mRNA and facilitates the initiation of translation. Any solutes suitable for cell electroporation, which can contain factors facilitating cellular permeability and viability such as sugars, peptides, lipids, proteins, antioxidants, and surfactants can be included.

RNA can be introduced into target cells using any of a number of different methods, for instance, commercially available methods which include, but are not limited to, electroporation (Amaxa Nucleofector-II (Amaxa Biosystems, Cologne, Germany)), (ECM 830 (BTX) (Harvard Instruments, Boston, Mass.) or the Gene Pulser II (BioRad, Denver, Colo.), Multiporator (Eppendort, Hamburg Germany), cationic liposome mediated transfection using lipofection, polymer encapsulation, peptide mediated transfection, or biolistic particle delivery systems such as "gene guns" (see, for example, Nishikawa, et al. Hum Gene Ther., 12(8):861-70 (2001).

The nucleic acid sequences coding for the desired molecules can be obtained using recombinant methods known in the art, such as, for example by screening libraries from cells expressing the gene, by deriving the gene from a vector known to include the same, or by isolating directly from cells and tissues containing the same, using standard techniques. Alternatively, the gene of interest can be produced synthetically, rather than cloned.

Non-Viral Delivery Methods

In some aspects, non-viral methods can be used to deliver a nucleic acid encoding a CAR, e.g., a NKR-CAR or a TCAR, described herein into a cell or tissue or a subject.

In some embodiments, the non-viral method includes the use of a transposon (also called a transposable element). In some embodiments, a transposon is a piece of DNA that can insert itself at a location in a genome, for example, a piece of DNA that is capable of self-replicating and inserting its copy into a genome, or a piece of DNA that can be spliced out of a longer nucleic acid and inserted into another place in a genome. For example, a transposon comprises a DNA sequence made up of inverted repeats flanking genes for transposition.

Exemplary methods of nucleic acid delivery using a transposon include a Sleeping Beauty transposon system (SBTS) and a piggyBac (PB) transposon system. See, e.g., Aronovich et al. Hum. Mol. Genet. 20.R1(2011):R14-20; Singh et al. Cancer Res. 15(2008):2961-2971; Huang et al. Mol. Ther. 16(2008):580-589; Grabundzija et al. Mol. Ther. 18(2010):1200-1209; Kebriaei et al. Blood. 122.21(2013): 166; Williams. Molecular Therapy 16.9(2008):1515-16; Bell et al. Nat. Protoc. 2.12(2007):3153-65; and Ding et al. Cell. 122.3(2005):473-83, all of which are incorporated herein by reference.

The SBTS includes two components: 1) a transposon containing a transgene and 2) a source of transposase enzyme. The transposase can transpose the transposon from a carrier plasmid (or other donor DNA) to a target DNA, such as a host cell chromosome/genome. For example, the transposase binds to the carrier plasmid/donor DNA, cuts the transposon (including transgene(s)) out of the plasmid, and inserts it into the genome of the host cell. See, e.g., Aronovich et al. supra.

Exemplary transposons include a pT2-based transposon. See, e.g., Grabundzija et al. Nucleic Acids Res. 41.3(2013): 1829-47; and Singh et al. Cancer Res. 68.8(2008): 2961-2971, all of which are incorporated herein by reference. Exemplary transposases include a Tc1/mariner-type transposase, e.g., the SB10 transposase or the SB11 transposase (a hyperactive transposase which can be expressed, e.g., from a cytomegalovirus promoter). See, e.g., Aronovich et al.; Kebriaei et al.; and Grabundzija et al., all of which are incorporated herein by reference.

Use of the SBTS permits efficient integration and expression of a transgene, e.g., a nucleic acid encoding a CAR described herein. Provided herein are methods of generating a cell, e.g., T cell or NK cell, that stably expresses a CAR described herein, e.g., using a transposon system such as SBTS.

In accordance with methods described herein, in some embodiments, one or more nucleic acids, e.g., plasmids, containing the SBTS components are delivered to a cell (e.g., T or NK cell). For example, the nucleic acid(s) are delivered by standard methods of nucleic acid (e.g., plasmid DNA) delivery, e.g., methods described herein, e.g., electroporation, transfection, or lipofection. In some embodiments, the nucleic acid contains a transposon comprising a transgene, e.g., a nucleic acid encoding a CAR described herein. In some embodiments, the nucleic acid contains a transposon comprising a transgene (e.g., a nucleic acid encoding a CAR described herein) as well as a nucleic acid sequence encoding a transposase enzyme. In other embodiments, a system with two nucleic acids is provided, e.g., a dual-plasmid system, e.g., where a first plasmid contains a transposon comprising a transgene, and a second plasmid contains a nucleic acid sequence encoding a transposase enzyme. For example, the first and the second nucleic acids are co-delivered into a host cell.

In some embodiments, cells, e.g., T or NK cells, are generated that express a CAR described herein by using a combination of gene insertion using the SBTS and genetic editing using a nuclease (e.g., Zinc finger nucleases (ZFNs), Transcription Activator-Like Effector Nucleases (TALENs), the CRISPR/Cas system, or engineered meganuclease re-engineered homing endonucleases).

In some embodiments, use of a non-viral method of delivery permits reprogramming of cells, e.g., T or NK cells, and direct infusion of the cells into a subject. Advantages of non-viral vectors include but are not limited to the ease and relatively low cost of producing sufficient amounts required to meet a patient population, stability during storage, and lack of immunogenicity.

In other embodiments where a non-viral delivery system is utilized, an exemplary delivery vehicle is a liposome. The use of lipid formulations is contemplated for the introduction of the nucleic acids into a host cell (in vitro, ex vivo or in vivo). In another aspect, the nucleic acid may be associated with a lipid. The nucleic acid associated with a lipid may be encapsulated in the aqueous interior of a liposome, interspersed within the lipid bilayer of a liposome, attached to a liposome via a linking molecule that is associated with both the liposome and the oligonucleotide, entrapped in a liposome, complexed with a liposome, dispersed in a solution containing a lipid, mixed with a lipid, combined with a lipid, contained as a suspension in a lipid, contained or complexed with a micelle, or otherwise associated with a lipid. Lipid, lipid/DNA or lipid/expression vector associated compositions are not limited to any particular structure in solution. For example, they may be present in a bilayer structure, as micelles, or with a "collapsed" structure. They may also simply be interspersed in a solution, possibly forming aggregates that are not uniform in size or shape. Lipids are fatty substances which may be naturally occurring or synthetic lipids. For example, lipids include the fatty droplets that naturally occur in the cytoplasm as well as the class of compounds which contain long-chain aliphatic hydrocarbons and their derivatives, such as fatty acids, alcohols, amines, amino alcohols, and aldehydes.

Lipids suitable for use can be obtained from commercial sources. For example, dimyristyl phosphatidylcholine ("DMPC") can be obtained from Sigma, St. Louis, Mo.; dicetyl phosphate ("DCP") can be obtained from K & K Laboratories (Plainview, N.Y.); cholesterol ("Chol") can be obtained from Calbiochem-Behring; dimyristyl phosphatidylglycerol ("DMPG") and other lipids may be obtained from Avanti Polar Lipids, Inc. (Birmingham, Ala.). Stock solutions of lipids in chloroform or chloroform/methanol can be stored at about −20° C. Chloroform is used as the only solvent since it is more readily evaporated than methanol. "Liposome" is a generic term encompassing a variety of single and multilamellar lipid vehicles formed by the generation of enclosed lipid bilayers or aggregates. Liposomes can be characterized as having vesicular structures with a phospholipid bilayer membrane and an inner aqueous medium. Multilamellar liposomes have multiple lipid layers separated by aqueous medium. They form spontaneously when phospholipids are suspended in an excess of aqueous solution. The lipid components undergo self-rearrangement before the formation of closed structures and entrap water and dissolved solutes between the lipid bilayers (Ghosh et al., 1991 Glycobiology 5: 505-10). However, compositions that have different structures in solution than the normal vesicular structure are also encompassed. For example, the lipids may assume a micellar structure or merely exist as nonuniform aggregates of lipid molecules. Also contemplated are lipofectamine-nucleic acid complexes.

Sources of Cells

Prior to expansion and genetic modification, a source of cells (e.g., immune effector cells, e.g., T cells or NK cells) is obtained from a subject. The term "subject" is intended to include living organisms in which an immune response can be elicited (e.g., mammals). Examples of subjects include humans, dogs, cats, mice, rats, and transgenic species thereof. T cells can be obtained from a number of sources, including peripheral blood mononuclear cells, bone marrow, lymph node tissue, cord blood, thymus tissue, tissue from a site of infection, ascites, pleural effusion, spleen tissue, and tumors.

In certain embodiments of the present invention, any number of immune effector cell (e.g., T cell or NK cell) lines available in the art, may be used. In certain embodiments of the present invention, T cells can be obtained from a unit of blood collected from a subject using any number of techniques known to the skilled artisan, such as Ficoll™ separation. In one preferred embodiment, cells from the circulating blood of an individual are obtained by apheresis. The apheresis product typically contains lymphocytes, including T cells, monocytes, granulocytes, B cells, other nucleated white blood cells, red blood cells, and platelets. In one embodiment, the cells collected by apheresis may be washed to remove the plasma fraction and to place the cells in an appropriate buffer or media for subsequent processing steps. In one embodiment of the invention, the cells are washed with phosphate buffered saline (PBS). In an alternative embodiment, the wash solution lacks calcium and may lack magnesium or may lack many if not all divalent cations. Initial activation steps in the absence of calcium lead to magnified activation. As those of ordinary skill in the art would readily appreciate a washing step may be accomplished by methods known to those in the art, such as by using a semi-automated "flow-through" centrifuge (for example, the Cobe 2991 cell processor, the Baxter CytoMate, or the Haemonetics Cell Saver 5) according to the manufacturer's instructions. After washing, the cells may be resuspended in a variety of biocompatible buffers, such as, for example, Ca-free, Mg-free PBS, PlasmaLyte A, or other saline solution with or without buffer. Alternatively, the undesirable components of the apheresis sample may be removed and the cells directly resuspended in culture media.

It is recognized that the methods of the application can utilize culture media conditions comprising 5% or less, for example 2%, human AB serum, and employ known culture media conditions and compositions, for example those described in Smith et al., "Ex vivo expansion of human T cells for adoptive immunotherapy using the novel Xeno-free CTS Immune Cell Serum Replacement" *Clinical & Translational Immunology* (2015) 4, e31; doi:10.1038/cti.2014.31.

In another embodiment, T cells are isolated from peripheral blood lymphocytes by lysing the red blood cells and depleting the monocytes, for example, by centrifugation through a PERCOLL™ gradient or by counterflow centrifugal elutriation. A specific subpopulation of T cells, such as $CD3^+$, $CD28^+$, $CD4^+$, $CD8^+$, $CD45RA^+$, and $CD45RO^+$ T cells, can be further isolated by positive or negative selection techniques. For example, in one embodiment, T cells are isolated by incubation with anti-CD3/anti-CD28 (e.g., 3x28)-conjugated beads, such as DYNABEADS® M-450 CD3/CD28 T, for a time period sufficient for positive selection of the desired T cells. In one embodiment, the time period is about 30 minutes. In a further embodiment, the time period ranges from 30 minutes to 36 hours or longer and all integer values there between. In a further embodiment, the time period is at least 1, 2, 3, 4, 5, or 6 hours. In yet another preferred embodiment, the time period is 10 to 24 hours. In one preferred embodiment, the incubation time period is 24 hours. For isolation of T cells from patients with leukemia, use of longer incubation times, such as 24 hours, can increase cell yield. Longer incubation times may be used to isolate T cells in any situation where there are few T cells as compared to other cell types, such in isolating tumor infiltrating lymphocytes (TIL) from tumor tissue or from immunocompromised individuals. Further, use of longer incubation times can increase the efficiency of capture of CD8+ T cells. Thus, by simply shortening or lengthening the time T cells are allowed to bind to the CD3/CD28 beads and/or by increasing or decreasing the ratio of beads to T cells (as described further herein), subpopulations of T cells can be preferentially selected for or against at culture initiation or at other time points during the process. Additionally, by increasing or decreasing the ratio of anti-CD3 and/or anti-CD28 antibodies on the beads or other surface, subpopulations of T cells can be preferentially selected for or against at culture initiation or at other desired time points. The skilled artisan would recognize that multiple rounds of selection can also be used in the context of this invention. In certain embodiments, it may be desirable to perform the selection procedure and use the "unselected" cells in the activation and expansion process. "Unselected" cells can also be subjected to further rounds of selection.

Enrichment of a T cell population by negative selection can be accomplished with a combination of antibodies directed to surface markers unique to the negatively selected cells. One method is cell sorting and/or selection via negative magnetic immunoadherence or flow cytometry that uses a cocktail of monoclonal antibodies directed to cell surface markers present on the cells negatively selected. For example, to enrich for $CD4^+$ cells by negative selection, a monoclonal antibody cocktail typically includes antibodies to CD14, CD20, CD11b, CD16, HLA-DR, and CD8. In certain embodiments, it may be desirable to enrich for or positively select for regulatory T cells which typically express $CD4^+$, $CD25^+$, $CD62L^{hi}$, $GITR^+$, and $FoxP3^+$. Alternatively, in certain embodiments, T regulatory cells are depleted by anti-C25 conjugated beads or other similar method of selection.

The methods described herein can include, e.g., selection of a specific subpopulation of immune effector cells, e.g., T cells, that are a T regulatory cell-depleted population, CD25+ depleted cells, using, e.g., a negative selection technique, e.g., described herein. Preferably, the population of T regulatory depleted cells contains less than 30%, 25%, 20%, 15%, 10%, 5%, 4%, 3%, 2%, 1% of CD25+ cells.

In one embodiment, T regulatory cells, e.g., CD25+ T cells, are removed from the population using an anti-CD25 antibody, or fragment thereof, or a CD25-binding ligand, IL-2. In one embodiment, the anti-CD25 antibody, or fragment thereof, or CD25-binding ligand is conjugated to a substrate, e.g., a bead, or is otherwise coated on a substrate, e.g., a bead. In one embodiment, the anti-CD25 antibody, or fragment thereof, is conjugated to a substrate as described herein.

In one embodiment, the T regulatory cells, e.g., CD25+ T cells, are removed from the population using CD25 depletion reagent from Miltenyi™. In one embodiment, the ratio of cells to CD25 depletion reagent is 1e7 cells to 20 uL, or 1e7 cells to 15 uL, or 1e7 cells to 10 uL, or 1e7 cells to 5 uL, or 1e7 cells to 2.5 uL, or 1e7 cells to 1.25 uL. In one embodiment, e.g., for T regulatory cells, e.g., CD25+ depletion, greater than 500 million cells/ml is used. In a further aspect, a concentration of cells of 600, 700, 800, or 900 million cells/ml is used.

In one embodiment, the population of immune effector cells to be depleted includes about $6 \times 10^9$ CD25+ T cells. In other aspects, the population of immune effector cells to be depleted include about $1 \times 10^9$ to $1 \times 10^{10}$ CD25+ T cell, and any integer value in between. In one embodiment, the resulting population T regulatory depleted cells has $2\times10^9$ T regulatory cells, e.g., CD25+ cells, or less (e.g., $1\times10^9$, $5\times10^8$, $1\times10^8$, $5\times10^7$, $1\times10^7$, or less CD25+ cells).

In one embodiment, the T regulatory cells, e.g., CD25+ cells, are removed from the population using the CliniMAC system with a depletion tubing set, such as, e.g., tubing 162-01. In one embodiment, the CliniMAC system is run on a depletion setting such as, e.g., DEPLETION2.1.

Without wishing to be bound by a particular theory, decreasing the level of negative regulators of immune cells (e.g., decreasing the number of unwanted immune cells, e.g., $T_{REG}$ cells), in a subject prior to apheresis or during manufacturing of a CAR-expressing cell product can reduce the risk of subject relapse. For example, methods of depleting $T_{REG}$ cells are known in the art. Methods of decreasing $T_{REG}$ cells include, but are not limited to, cyclophosphamide, anti-GITR antibody (an anti-GITR antibody described herein), CD25-depletion, and combinations thereof.

In some embodiments, the manufacturing methods comprise reducing the number of (e.g., depleting) $T_{REG}$ cells prior to manufacturing of the CAR-expressing cell. For example, manufacturing methods comprise contacting the sample, e.g., the apheresis sample, with an anti-GITR antibody and/or an anti-CD25 antibody (or fragment thereof, or a CD25-binding ligand), e.g., to deplete $T_{REG}$ cells prior to manufacturing of the CAR-expressing cell (e.g., T cell, NK cell) product.

In an embodiment, a subject is pre-treated with one or more therapies that reduce $T_{REG}$ cells prior to collection of cells for CAR-expressing cell product manufacturing, thereby reducing the risk of subject relapse to CAR-expressing cell treatment. In an embodiment, methods of decreasing $T_{REG}$ cells include, but are not limited to, administration to the subject of one or more of cyclophosphamide, anti-GITR antibody, CD25-depletion, or a combination thereof. Administration of one or more of cyclophosphamide, anti-GITR antibody, CD25-depletion, or a combination thereof, can occur before, during or after an infusion of the CAR-expressing cell product.

In an embodiment, a subject is pre-treated with cyclophosphamide prior to collection of cells for CAR-expressing cell product manufacturing, thereby reducing the risk of subject relapse to CAR-expressing cell treatment. In an embodiment, a subject is pre-treated with an anti-GITR antibody prior to collection of cells for CAR-expressing cell product manufacturing, thereby reducing the risk of subject relapse to CAR-expressing cell treatment.

In one embodiment, the population of cells to be removed are neither the regulatory T cells or tumor cells, but cells that otherwise negatively affect the expansion and/or function of CART cells, e.g. cells expressing CD14, CD11b, CD33, CD15, or other markers expressed by potentially immune suppressive cells. In one embodiment, such cells are envisioned to be removed concurrently with regulatory T cells and/or tumor cells, or following said depletion, or in another order.

The methods described herein can include more than one selection step, e.g., more than one depletion step. Enrichment of a T cell population by negative selection can be accomplished, e.g., with a combination of antibodies directed to surface markers unique to the negatively selected cells. One method is cell sorting and/or selection via negative magnetic immunoadherence or flow cytometry that uses a cocktail of monoclonal antibodies directed to cell surface markers present on the cells negatively selected. For example, to enrich for CD4+ cells by negative selection, a monoclonal antibody cocktail can include antibodies to CD14, CD20, CD11b, CD16, HLA-DR, and CD8.

The methods described herein can further include removing cells from the population which express a tumor antigen, e.g., a tumor antigen that does not comprise CD25, e.g., CD19, CD30, CD38, CD123, CD20, CD14 or CD11b, to thereby provide a population of T regulatory depleted, e.g., CD25+ depleted, and tumor antigen depleted cells that are suitable for expression of a CAR, e.g., a CAR described herein. In one embodiment, tumor antigen expressing cells are removed simultaneously with the T regulatory, e.g., CD25+ cells. For example, an anti-CD25 antibody, or fragment thereof, and an anti-tumor antigen antibody, or fragment thereof, can be attached to the same substrate, e.g., bead, which can be used to remove the cells or an anti-CD25 antibody, or fragment thereof, or the anti-tumor antigen antibody, or fragment thereof, can be attached to separate beads, a mixture of which can be used to remove the cells. In other embodiments, the removal of T regulatory cells, e.g., CD25+ cells, and the removal of the tumor antigen expressing cells is sequential, and can occur, e.g., in either order.

Also provided are methods that include removing cells from the population which express a check point inhibitor, e.g., a check point inhibitor described herein, e.g., one or more of PD1+ cells, LAG3+ cells, and TIM3+ cells, to thereby provide a population of T regulatory depleted, e.g., CD25+ depleted cells, and check point inhibitor depleted cells, e.g., PD1+, LAG3+ and/or TIM3+ depleted cells. Exemplary check point inhibitors include B7-H1, B7-1, CD160, P1H, 2B4, PD1, TIM3, CEACAM (e.g., CEACAM-1, CEACAM-3 and/or CEACAM-5), LAG3, TIGIT, CTLA-4, BTLA and LAIR1. In one embodiment, check point inhibitor expressing cells are removed simultaneously with the T regulatory, e.g., CD25+ cells. For example, an anti-CD25 antibody, or fragment thereof, and an anti-check point inhibitor antibody, or fragment thereof, can be attached to the same bead which can be used to remove the cells, or an anti-CD25 antibody, or fragment thereof, and the anti-check point inhibitor antibody, or fragment there, can be attached to separate beads, a mixture of which can be used to remove the cells. In other embodiments, the removal of T regulatory cells, e.g., CD25+ cells, and the removal of the check point inhibitor expressing cells is sequential, and can occur, e.g., in either order.

In one embodiment, a T cell population can be selected that expresses one or more of IFN-γ, TNFα, IL-17A, IL-2, IL-3, IL-4, GM-CSF, IL-10, IL-13, granzyme B, and perforin, or other appropriate molecules, e.g., other cytokines. Methods for screening for cell expression can be determined, e.g., by the methods described in PCT Publication No.: WO 2013/126712.

For isolation of a desired population of cells by positive or negative selection, the concentration of cells and surface (e.g., particles such as beads) can be varied. In certain embodiments, it may be desirable to significantly decrease the volume in which beads and cells are mixed together (i.e., increase the concentration of cells), to ensure maximum contact of cells and beads. For example, in one embodiment, a concentration of 2 billion cells/ml is used. In one embodiment, a concentration of 1 billion cells/ml is used. In a further embodiment, greater than 100 million cells/ml is used. In a further embodiment, a concentration of cells of 10, 15, 20, 25, 30, 35, 40, 45, or 50 million cells/ml is used. In yet another embodiment, a concentration of cells from 75, 80, 85, 90, 95, or 100 million cells/ml is used. In further embodiments, concentrations of 125 or 150 million cells/ml can be used. Using high concentrations can result in increased cell yield, cell activation, and cell expansion. Further, use of high cell concentrations allows more efficient capture of cells that may weakly express target antigens of interest, such as CD28-negative T cells, or from samples where there are many tumor cells present (i.e., leukemic blood, tumor tissue, etc.). Such populations of cells may have therapeutic value and would be desirable to obtain. For example, using high concentration of cells allows more efficient selection of CD8+ T cells that normally have weaker CD28 expression.

In a related embodiment, it may be desirable to use lower concentrations of cells. By significantly diluting the mixture of T cells and surface (e.g., particles such as beads), interactions between the particles and cells is minimized. This selects for cells that express high amounts of desired antigens to be bound to the particles. For example, CD4+ T cells express higher levels of CD28 and are more efficiently captured than CD8+ T cells in dilute concentrations. In one embodiment, the concentration of cells used is $5 \times 10^6$/ml. In other embodiments, the concentration used can be from about $1 \times 10^5$/ml to $1 \times 10^6$/ml, and any integer value in between.

In other embodiments, the cells may be incubated on a rotator for varying lengths of time at varying speeds at either 2-10° C. or at room temperature.

T cells for stimulation can also be frozen after a washing step. Wishing not to be bound by theory, the freeze and subsequent thaw step provides a more uniform product by removing granulocytes and to some extent monocytes in the cell population. After the washing step that removes plasma and platelets, the cells may be suspended in a freezing solution. While many freezing solutions and parameters are known in the art and will be useful in this context, one method involves using PBS containing 20% DMSO and 8% human serum albumin, or culture media containing 10% Dextran 40 and 5% Dextrose, 20% Human Serum Albumin and 7.5% DMSO, or 31.25% Plasmalyte-A, 31.25% Dextrose 5%, 0.45% NaCl, 10% Dextran 40 and 5% Dextrose, 20% Human Serum Albumin, and 7.5% DMSO or other suitable cell freezing media containing for example, Hespan and PlasmaLyte A, the cells then are frozen to −80° C. at a rate of 1° per minute and stored in the vapor phase of a liquid nitrogen storage tank. Other methods of controlled freezing may be used as well as uncontrolled freezing immediately at −20° C. or in liquid nitrogen.

In certain embodiments, cryopreserved cells are thawed and washed as described herein and allowed to rest for one hour at room temperature prior to activation using the methods of the present invention.

Also contemplated in the context of the invention is the collection of blood samples or apheresis product from a subject at a time period prior to when the expanded cells as described herein might be needed. As such, the source of the cells to be expanded can be collected at any time point necessary, and desired cells, such as T cells, isolated and frozen for later use in T cell therapy for any number of diseases or conditions that would benefit from T cell therapy, such as those described herein. In one embodiment a blood sample or an apheresis is taken from a generally healthy subject. In certain embodiments, a blood sample or an apheresis is taken from a generally healthy subject who is at risk of developing a disease, but who has not yet developed a disease, and the cells of interest are isolated and frozen for later use. In certain embodiments, the T cells may be expanded, frozen, and used at a later time. In certain embodiments, samples are collected from a patient shortly after diagnosis of a particular disease as described herein but prior to any treatments. In a further embodiment, the cells are isolated from a blood sample or an apheresis from a subject prior to any number of relevant treatment modalities, including but not limited to treatment with agents such as natalizumab, efalizumab, antiviral agents, chemotherapy, radiation, immunosuppressive agents, such as cyclosporin, azathioprine, methotrexate, mycophenolate, and FK506, antibodies, or other immunoablative agents such as CAMPATH, anti-CD3 antibodies, cytoxan, fludarabine, cyclosporin, FK506, rapamycin, mycophenolic acid, steroids, FR901228, and irradiation. These drugs inhibit either the calcium dependent phosphatase calcineurin (cyclosporine and FK506) or inhibit the p70S6 kinase that is important for growth factor induced signaling (rapamycin). (Liu et al., Cell 66:807-815, 1991; Henderson et al., Immun. 73:316-321, 1991; Bierer et al., Curr. Opin. Immun. 5:763-773, 1993). In a further embodiment, the cells are isolated for a patient and frozen for later use in conjunction with (e.g., before, simultaneously or following) bone marrow or stem cell transplantation, T cell ablative therapy using either chemotherapy agents such as, fludarabine, external-beam radiation therapy (XRT), cyclophosphamide, or antibodies such as OKT3 or CAMPATH. In another embodiment, the cells are isolated prior to and can be frozen for later use for treatment following B-cell ablative therapy such as agents that react with CD20, e.g., Rituxan.

In a further embodiment of the present invention, T cells are obtained from a patient directly following treatment that leaves the subject with functional T cells. In this regard, it has been observed that following certain cancer treatments, in particular treatments with drugs that damage the immune system, shortly after treatment during the period when patients would normally be recovering from the treatment, the quality of T cells obtained may be optimal or improved for their ability to expand ex vivo. Likewise, following ex vivo manipulation using the methods described herein, these cells may be in a preferred state for enhanced engraftment and in vivo expansion. Thus, it is contemplated within the context of the present invention to collect blood cells, including T cells, dendritic cells, or other cells of the hematopoietic lineage, during this recovery phase. Further, in certain embodiments, mobilization (for example, mobilization with GM-CSF) and conditioning regimens can be used to create a condition in a subject wherein repopulation, recirculation, regeneration, and/or expansion of particular cell types is favored, especially during a defined window of time following therapy. Illustrative cell types include T cells, B cells, dendritic cells, and other cells of the immune system.

In one embodiment, the immune effector cells expressing a CAR molecule, e.g., a CAR molecule described herein, are obtained from a subject that has received a low, immune enhancing dose of an mTOR inhibitor. In an embodiment, the population of immune effector cells, e.g., T cells, to be engineered to express a CAR, are harvested after a sufficient time, or after sufficient dosing of the low, immune enhancing, dose of an mTOR inhibitor, such that the level of PD1 negative immune effector cells, e.g., T cells, or the ratio of PD1 negative immune effector cells, e.g., T cells/PD1 positive immune effector cells, e.g., T cells, in the subject or harvested from the subject has been, at least transiently, increased.

In other embodiments, population of immune effector cells, e.g., T cells, which have, or will be engineered to express a CAR, can be treated ex vivo by contact with an amount of an mTOR inhibitor that increases the number of PD1 negative immune effector cells, e.g., T cells or increases the ratio of PD1 negative immune effector cells, e.g., T cells/PD1 positive immune effector cells, e.g., T cells.

In one embodiment, a T cell population is diaglycerol kinase (DGK)-deficient. DGK-deficient cells include cells that do not express DGK RNA or protein, or have reduced or inhibited DGK activity. DGK-deficient cells can be generated by genetic approaches, e.g., administering RNA-interfering agents, e.g., siRNA, shRNA, miRNA, to reduce or prevent DGK expression. Alternatively, DGK-deficient cells can be generated by treatment with DGK inhibitors described herein.

In one embodiment, a T cell population is Ikaros-deficient. Ikaros-deficient cells include cells that do not express Ikaros RNA or protein, or have reduced or inhibited Ikaros activity, Ikaros-deficient cells can be generated by genetic approaches, e.g., administering RNA-interfering agents, e.g., siRNA, shRNA, miRNA, to reduce or prevent Ikaros expression. Alternatively, Ikaros-deficient cells can be generated by treatment with Ikaros inhibitors, e.g., lenalidomide.

In embodiments, a T cell population is DGK-deficient and Ikaros-deficient, e.g., does not express DGK and Ikaros, or has reduced or inhibited DGK and Ikaros activity. Such DGK and Ikaros-deficient cells can be generated by any of the methods described herein.

In an embodiment, the NK cells are obtained from the subject. In another embodiment, the NK cells are an NK cell line, e.g., NK-92 cell line (Conkwest).

Allogeneic CAR Immune Effector Cells

In embodiments described herein, the immune effector cell can be an allogeneic immune effector cell, e.g., T cell or NK cell. For example, the cell can be an allogeneic T cell, e.g., an allogeneic T cell lacking expression of a functional T cell receptor (TCR) and/or human leukocyte antigen (HLA), e.g., HLA class I and/or HLA class II.

A T cell lacking a functional TCR can be, e.g., engineered such that it does not express any functional TCR on its surface, engineered such that it does not express one or more subunits that comprise a functional TCR (e.g., engineered such that it does not express (or exhibits reduced expression) of TCR alpha, TCR beta, TCR gamma, TCR delta, TCR epsilon, and/or TCR zeta) or engineered such that it produces very little functional TCR on its surface. Alternatively, the T cell can express a substantially impaired TCR, e.g., by expression of mutated or truncated forms of one or more of the subunits of the TCR. The term "substantially impaired TCR" means that this TCR will not elicit an adverse immune reaction in a host.

A T cell described herein can be, e.g., engineered such that it does not express a functional HLA on its surface. For example, a T cell described herein, can be engineered such that cell surface expression HLA, e.g., HLA class 1 and/or HLA class II, is downregulated. In some aspects, downregulation of HLA may be accomplished by reducing or eliminating expression of beta-2 microglobulin (B2M).

In some embodiments, the T cell can lack a functional TCR and a functional HLA, e.g., HLA class I and/or HLA class II.

Modified T cells that lack expression of a functional TCR and/or HLA can be obtained by any suitable means, including a knock out or knock down of one or more subunit of TCR or HLA. For example, the T cell can include a knock down of TCR and/or HLA using siRNA, shRNA, clustered regularly interspaced short palindromic repeats (CRISPR) transcription-activator like effector nuclease (TALEN), or zinc finger endonuclease (ZFN).

In some embodiments, the allogeneic cell can be a cell which does not expresses or expresses at low levels an inhibitory molecule, e.g. by any method described herein. For example, the cell can be a cell that does not express or expresses at low levels an inhibitory molecule, e.g., that can decrease the ability of a CAR-expressing cell to mount an immune effector response. Examples of inhibitory molecules include PD1, PD-L1, PD-L2, CTLA4, TIM3, CEACAM (e.g., CEACAM-1, CEACAM-3 and/or CEACAM-5), LAG3, VISTA, BTLA, TIGIT, LAIR1, CD160, 2B4, CD80, CD86, B7-H3 (CD276), B7-H4 (VTCN1), HVEM (TNFRSF14 or CD270), KIR, A2aR, MHC class I, MHC class II, GAL9, adenosine, and TGFR beta. Inhibition of an inhibitory molecule, e.g., by inhibition at the DNA, RNA or protein level, can optimize a CAR-expressing cell performance. In embodiments, an inhibitory nucleic acid, e.g., an inhibitory nucleic acid, e.g., a dsRNA, e.g., an siRNA or shRNA, a clustered regularly interspaced short palindromic repeats (CRISPR), a transcription-activator like effector nuclease (TALEN), or a zinc finger endonuclease (ZFN), e.g., as described herein, can be used.

siRNA and shRNA to Inhibit TCR or HLA

In some embodiments, TCR expression and/or HLA expression can be inhibited using siRNA or shRNA that targets a nucleic acid encoding a TCR and/or HLA, and/or an inhibitory molecule described herein (e.g., PD1, PD-L1, PD-L2, CTLA4, TIM3, CEACAM (e.g., CEACAM-1, CEACAM-3 and/or CEACAM-5), LAG3, VISTA, BTLA, TIGIT, LAIR1, CD160, 2B4, CD80, CD86, B7-H3 (CD276), B7-H4 (VTCN1), HVEM (TNFRSF14 or CD270), KIR, A2aR, MHC class I, MHC class II, GAL9, adenosine, and TGFR beta), in a cell.

Expression of siRNA and shRNAs in T cells can be achieved using any conventional expression system, e.g., such as a lentiviral expression system.

Exemplary shRNAs that downregulate expression of one or more components of the TCR are described, e.g., in US Publication No.: 2012/0321667. Exemplary siRNA and shRNA that downregulate expression of HLA class I and/or HLA class II genes are described, e.g., in U.S. publication No.: US 2007/0036773.

CRISPR to Inhibit TCR or HLA

"CRISPR" or "CRISPR to TCR and/or HLA" or "CRISPR to inhibit TCR and/or HLA" as used herein refers to a set of clustered regularly interspaced short palindromic repeats, or a system comprising such a set of repeats. "Cas", as used herein, refers to a CRISPR-associated protein. A "CRISPR/Cas" system refers to a system derived from CRISPR and Cas which can be used to silence or mutate a TCR and/or HLA gene, and/or an inhibitory molecule described herein (e.g., PD1, PD-L1, PD-L2, CTLA4, TIM3, CEACAM (e.g., CEACAM-1, CEACAM-3 and/or CEACAM-5), LAG3, VISTA, BTLA, TIGIT, LAIR1, CD160, 2B4, CD80, CD86, B7-H3 (CD276), B7-H4 (VTCN1), HVEM (TNFRSF14 or CD270), KIR, A2aR, MHC class I, MHC class II, GAL9, adenosine, and TGFR beta).

Naturally-occurring CRISPR/Cas systems are found in approximately 40% of sequenced eubacteria genomes and 90% of sequenced archaea. Grissa et al. (2007) BMC Bioinformatics 8: 172. This system is a type of prokaryotic immune system that confers resistance to foreign genetic elements such as plasmids and phages and provides a form of acquired immunity. Barrangou et al. (2007) *Science* 315: 1709-1712; Marragini et al. (2008) *Science* 322: 1843-1845.

The CRISPR/Cas system has been modified for use in gene editing (silencing, enhancing or changing specific genes) in eukaryotes such as mice or primates. Wiedenheft et al. (2012) *Nature* 482: 331-8. This is accomplished by introducing into the eukaryotic cell a plasmid containing a specifically designed CRISPR and one or more appropriate Cas.

The CRISPR sequence, sometimes called a CRISPR locus, comprises alternating repeats and spacers. In a naturally-occurring CRISPR, the spacers usually comprise sequences foreign to the bacterium such as a plasmid or phage sequence; in the TCR and/or HLA CRISPR/Cas system, the spacers are derived from the TCR or HLA gene sequence.

RNA from the CRISPR locus is constitutively expressed and processed by Cas proteins into small RNAs. These comprise a spacer flanked by a repeat sequence. The RNAs guide other Cas proteins to silence exogenous genetic elements at the RNA or DNA level. Horvath et al. (2010) *Science* 327: 167-170; Makarova et al. (2006) *Biology Direct* 1: 7. The spacers thus serve as templates for RNA molecules, analogously to siRNAs. Pennisi (2013) *Science* 341: 833-836.

As these naturally occur in many different types of bacteria, the exact arrangements of the CRISPR and structure, function and number of Cas genes and their product differ somewhat from species to species. Haft et al. (2005) *PLoS Comput. Biol.* 1: e60; Kunin et al. (2007) *Genome Biol.* 8: R61; Mojica et al. (2005) *J. Mol. Evol.* 60: 174-182; Bolotin et al. (2005) *Microbiol.* 151: 2551-2561; Pourcel et al. (2005) *Microbiol.* 151: 653-663; and Stern et al. (2010) *Trends. Genet.* 28: 335-340. For example, the Cse (Cas subtype, *E. coli*) proteins (e.g., CasA) form a functional complex, Cascade, that processes CRISPR RNA transcripts into spacer-repeat units that Cascade retains. Brouns et al. (2008) *Science* 321: 960-964. In other prokaryotes, Cas6 processes the CRISPR transcript. The CRISPR-based phage inactivation in *E. coli* requires Cascade and Cas3, but not Cas1 or Cas2. The Cmr (Cas RAMP module) proteins in *Pyrococcus furiosus* and other prokaryotes form a functional complex with small CRISPR RNAs that recognizes and cleaves complementary target RNAs. A simpler CRISPR system relies on the protein Cas9, which is a nuclease with two active cutting sites, one for each strand of the double helix. Combining Cas9 and modified CRISPR locus RNA can be used in a system for gene editing. Pennisi (2013) *Science* 341: 833-836.

The CRISPR/Cas system can thus be used to edit a TCR and/or HLA gene (adding or deleting a basepair), or introducing a premature stop which thus decreases expression of a TCR and/or HLA. The CRISPR/Cas system can alternatively be used like RNA interference, turning off TCR and/or HLA gene in a reversible fashion. In a mammalian cell, for example, the RNA can guide the Cas protein to a TCR and/or HLA promoter, sterically blocking RNA polymerases.

Artificial CRISPR/Cas systems can be generated which inhibit TCR and/or HLA, using technology known in the art, e.g., that described in U.S. Publication No. 20140068797 and Cong (2013) Science 339: 819-823. Other artificial CRISPR/Cas systems that are known in the art may also be generated which inhibit TCR and/or HLA, e.g., that described in Tsai (2014) Nature Biotechnol., 32:6 569-576, U.S. Pat. Nos. 8,871,445; 8,865,406; 8,795,965; 8,771,945; and 8,697,359.

TALEN to Inhibit TCR and/or HLA

"TALEN" or "TALEN to HLA and/or TCR" or "TALEN to inhibit HLA and/or TCR" refers to a transcription activator-like effector nuclease, an artificial nuclease which can be used to edit the HLA and/or TCR gene, and/or an inhibitory molecule described herein (e.g., PD1, PD-L1, PD-L2, CTLA4, TIM3, CEACAM (e.g., CEACAM-1, CEACAM-3 and/or CEACAM-5), LAG3, VISTA, BTLA, TIGIT, LAIR1, CD160, 2B4, CD80, CD86, B7-H3 (CD276), B7-H4 (VTCN1), HVEM (TNFRSF14 or CD270), KIR, A2aR, MHC class I, MHC class II, GAL9, adenosine, and TGFR beta).

TALENs are produced artificially by fusing a TAL effector DNA binding domain to a DNA cleavage domain. Transcription activator-like effects (TALEs) can be engineered to bind any desired DNA sequence, including a portion of the HLA or TCR gene. By combining an engineered TALE with a DNA cleavage domain, a restriction enzyme can be produced which is specific to any desired DNA sequence, including a HLA or TCR sequence. These can then be introduced into a cell, wherein they can be used for genome editing. Boch (2011) *Nature Biotech.* 29: 135-6; and Boch et al. (2009) *Science* 326: 1509-12; Moscou et al. (2009) *Science* 326: 3501.

TALEs are proteins secreted by *Xanthomonas* bacteria. The DNA binding domain contains a repeated, highly conserved 33-34 amino acid sequence, with the exception of the 12th and 13th amino acids. These two positions are highly variable, showing a strong correlation with specific nucleotide recognition. They can thus be engineered to bind to a desired DNA sequence.

To produce a TALEN, a TALE protein is fused to a nuclease (N), which is a wild-type or mutated FokI endonuclease. Several mutations to FokI have been made for its use in TALENs; these, for example, improve cleavage specificity or activity. Cermak et al. (2011) *Nucl. Acids Res.* 39: e82; Miller et al. (2011) *Nature Biotech.* 29: 143-8; Hockemeyer et al. (2011) *Nature Biotech.* 29: 731-734; Wood et al. (2011) *Science* 333: 307; Doyon et al. (2010) *Nature Methods* 8: 74-79; Szczepek et al. (2007) *Nature Biotech.* 25: 786-793; and Guo et al. (2010) *J. Mol. Biol.* 200: 96.

The FokI domain functions as a dimer, requiring two constructs with unique DNA binding domains for sites in the target genome with proper orientation and spacing. Both the number of amino acid residues between the TALE DNA binding domain and the FokI cleavage domain and the number of bases between the two individual TALEN binding sites appear to be important parameters for achieving high levels of activity. Miller et al. (2011) *Nature Biotech.* 29: 143-8.

A HLA or TCR TALEN can be used inside a cell to produce a double-stranded break (DSB). A mutation can be introduced at the break site if the repair mechanisms improperly repair the break via non-homologous end joining. For example, improper repair may introduce a frame shift mutation. Alternatively, foreign DNA can be introduced into the cell along with the TALEN; depending on the sequences of the foreign DNA and chromosomal sequence, this process can be used to correct a defect in the HLA or TCR gene or introduce such a defect into a wt HLA or TCR gene, thus decreasing expression of HLA or TCR.

TALENs specific to sequences in HLA or TCR can be constructed using any method known in the art, including various schemes using modular components. Zhang et al. (2011) *Nature Biotech.* 29: 149-53; Geibler et al. (2011) *PLoS ONE* 6: e19509.

Zinc Finger Nuclease to Inhibit HLA and/or TCR

"ZFN" or "Zinc Finger Nuclease" or "ZFN to HLA and/or TCR" or "ZFN to inhibit HLA and/or TCR" refer to a zinc finger nuclease, an artificial nuclease which can be used to edit the HLA and/or TCR gene, and/or an inhibitory molecule described herein (e.g., PD1, PD-L1, PD-L2, CTLA4, TIM3, CEACAM (e.g., CEACAM-1, CEACAM-3 and/or CEACAM-5), LAG3, VISTA, BTLA, TIGIT, LAIR1, CD160, 2B4, CD80, CD86, B7-H3 (CD276), B7-H4 (VTCN1), HVEM (TNFRSF14 or CD270), KIR, A2aR, MHC class I, MHC class II, GAL9, adenosine, and TGFR beta).

Like a TALEN, a ZFN comprises a FokI nuclease domain (or derivative thereof) fused to a DNA-binding domain. In the case of a ZFN, the DNA-binding domain comprises one or more zinc fingers. Carroll et al. (2011) *Genetics Society of America* 188: 773-782; and Kim et al. (1996) *Proc. Natl. Acad. Sci. USA* 93: 1156-1160.

A zinc finger is a small protein structural motif stabilized by one or more zinc ions. A zinc finger can comprise, for example, Cys2His2, and can recognize an approximately 3-bp sequence. Various zinc fingers of known specificity can be combined to produce multi-finger polypeptides which recognize about 6, 9, 12, 15 or 18-bp sequences. Various selection and modular assembly techniques are available to generate zinc fingers (and combinations thereof) recognizing specific sequences, including phage display, yeast one-hybrid systems, bacterial one-hybrid and two-hybrid systems, and mammalian cells.

Like a TALEN, a ZFN must dimerize to cleave DNA. Thus, a pair of ZFNs are required to target non-palindromic DNA sites. The two individual ZFNs must bind opposite strands of the DNA with their nucleases properly spaced apart. Bitinaite et al. (1998) *Proc. Natl. Acad. Sci. USA* 95: 10570-5.

Also like a TALEN, a ZFN can create a double-stranded break in the DNA, which can create a frame-shift mutation if improperly repaired, leading to a decrease in the expression and amount of HLA and/or TCR in a cell. ZFNs can also be used with homologous recombination to mutate in the HLA or TCR gene.

ZFNs specific to sequences in HLA AND/OR TCR can be constructed using any method known in the art. Cathomen et al. (2008) *Mol. Ther.* 16: 1200-7; Guo et al. (2010) *J. Mol. Biol.* 400: 96; U.S. Patent Publication 2011/0158957; and U.S. Patent Publication 2012/0060230.

Telomerase Expression

While not wishing to be bound by any particular theory, in some embodiments, a therapeutic T cell has short term persistence in a patient, due to shortened telomeres in the T cell; accordingly, transfection with a telomerase gene can lengthen the telomeres of the T cell and improve persistence of the T cell in the patient. See Carl June, "Adoptive T cell therapy for cancer in the clinic", Journal of Clinical Investigation, 117:1466-1476 (2007). Thus, in an embodiment, an immune effector cell, e.g., a T cell, ectopically expresses a telomerase subunit, e.g., the catalytic subunit of telomerase, e.g., TERT, e.g., hTERT. In some aspects, this disclosure provides a method of producing a CAR-expressing cell, comprising contacting a cell with a nucleic acid encoding a telomerase subunit, e.g., the catalytic subunit of telomerase, e.g., TERT, e.g., hTERT. The cell may be contacted with the nucleic acid before, simultaneous with, or after being contacted with a construct encoding a CAR.

In one aspect, the disclosure features a method of making a population of immune effector cells (e.g., T cells, NK cells). In an embodiment, the method comprises: providing a population of immune effector cells (e.g., T cells or NK cells), contacting the population of immune effector cells with a nucleic acid encoding a CAR; and contacting the population of immune effector cells with a nucleic acid encoding a telomerase subunit, e.g., hTERT, under conditions that allow for CAR and telomerase expression.

In an embodiment, the nucleic acid encoding the telomerase subunit is DNA. In an embodiment, the nucleic acid encoding the telomerase subunit comprises a promoter capable of driving expression of the telomerase subunit.

In an embodiment, hTERT has the amino acid sequence of GenBank Protein ID AAC51724.1 (Meyerson et al., "hEST2, the Putative Human Telomerase Catalytic Subunit Gene, Is Up-Regulated in Tumor Cells and during Immortalization" Cell Volume 90, Issue 4, 22 Aug. 1997, Pages 785-795) as follows:

(SEQ ID NO: 61)
MPRAPRCRAVRSLLRSHYREVLPLATFVRRLGPQGWRLVQRGDPAAFRAL

VAQCLVCVPWDARPPPAAPSFRQVSCLKELVARVLQRLCERGAKNVLAFG

FALLDGARGGPPEAFTTSVRSYLPNTVTDALRGSGAWGLLLRRVGDDVLV

HLLARCALFVLVAPSCAYQVCGPPLYQLGAATQARPPPHASGPRRRLGCE

RAWNHSVREAGVPLGLPAPGARRRGGSASRSLPLPKRPRRGAAPEPERTP

VGQGSWAHPGRTRGPSDRGFCVVSPARPAEEATSLEGALSGTRHSHPSVG

RQHHAGPPSTSRPPRPWDTPCPPVYAETKHFLYSSGDKEQLRPSFLLSSL

RPSLTGARRLVETIFLGSRPWMPGTPRRLPRLPQRYWQMRPLFLELLGNH

AQCPYGVLLKTHCPLRAAVTPAAGVCAREKPQGSVAAPEEEDTDPRRLVQ

LLRQHSSPWQVYGFVRACLRRLVPPGLWGSRHNERRFLRNTKKFISLGKH

AKLSLQELTWKMSVRGCAWLRRSPGVGCVPAAEHRLREEILAKFLHWLMS

VYVVELLRSFFYVTETTFQKNRLFFYRKSVWSKLQSIGIRQHLKRVQLRE

LSEAEVRQHREARPALLTSRLRFIPKPDGLRPIVNMDYVVGARTFRREKR

AERLTSRVKALFSVLNYERARRPGLLGASVLGLDDIHRAWRTFVLRVRAQ

DPPPELYFVKVDVTGAYDTIPQDRLTEVIASIIKPQNTYCVRRYAVVQKA

AHGHVRKAFKSHVSTLTDLQPYMRQFVAHLQETSPLRDAVVIEQSSSLNE

ASSGLFDVFLRFMCHHAVRIRGKSYVQCQGIPQGSILSTLLCSLCYGDME

NKLFAGIRRDGLLLRLVDDFLLVTPHLTHAKTFLRTLVRGVPEYGCVVNL

RKTVVNFPVEDEALGGTAFVQMPAHGLFPWCGLLLDTRTLEVQSDYSSYA

RTSIRASLTFNRGFKAGRNMRRKLFGVLRLKCHSLFLDLQVNSLQTVCTN

IYKILLLQAYRFHACVLQLPFHQQVWKNPTFFLRVISDTASLCYSILKAK

NAGMSLGAKGAAGPLPSEAVQWLCHQAFLLKLTRHRVTYVPLLGSLRTAQ

TQLSRKLPGTTLTALEAAANPALPSDFKTILD

In an embodiment, the hTERT has a sequence at least 80%, 85%, 90%, 95%, 96^, 97%, 98%, or 99% identical to the sequence of SEQ ID NO: 61. In an embodiment, the hTERT has a sequence of SEQ ID NO: 61. In an embodiment, the hTERT comprises a deletion (e.g., of no more than 5, 10, 15, 20, or 30 amino acids) at the N-terminus, the C-terminus, or both. In an embodiment, the hTERT comprises a transgenic amino acid sequence (e.g., of no more than 5, 10, 15, 20, or 30 amino acids) at the N-terminus, the C-terminus, or both.

In an embodiment, the hTERT is encoded by the nucleic acid sequence of GenBank Accession No. AF018167 (Meyerson et al., "hEST2, the Putative Human Telomerase Catalytic Subunit Gene, Is Up-Regulated in Tumor Cells and during Immortalization" Cell Volume 90, Issue 4, 22 Aug. 1997, Pages 785-795):

(SEQ ID NO: 62)

```
   1 caggcagcgt ggtcctgctg cgcacgtggg aagccctggc cccggccacc cccgcgatgc
  61 cgcgcgctcc ccgctgccga gccgtgcgct ccctgctgcg cagccactac cgcgaggtgc
 121 tgccgctggc cacgttcgtg cggcgcctgg ggccccaggg ctggcggctg gtgcagcgcg
 181 gggacccggc ggctttccgc gcgctggtgg cccagtgcct ggtgtgcgtg ccctgggacg
 241 cacggccgcc cccgccgcc cctccttcc gccaggtgtc ctgcctgaag gagctggtgg
 301 cccgagtgct gcagaggctg tgcgagcgcg gcgcgaagaa cgtgctggcc ttcggcttcg
 361 cgctgctgga cggggcccgc gggggccccc ccgaggcctt caccaccagc gtgcgcagct
 421 acctgcccaa cacggtgacc gacgcactgc ggggagcgg ggcgtggggg ctgctgttgc
 481 gccgcgtggg cgacgacgtg ctggttcacc tgctggcacg ctgcgcgctc tttgtgctgg
 541 tggctcccag ctgcgcctac caggtgtgcg ggccgccgct gtaccagctc ggcgctgcca
 601 ctcaggcccg gcccccgcca cacgctagtg gaccccgaag gcgtctggga tgcgaacggg
 661 cctggaacca tagcgtcagg gaggccgggg tccccctggg cctgccagcc ccgggtgcga
 721 ggaggcgcgg gggcagtgcc agccgaagtc tgccgttgcc caagaggccc aggcgtggcg
 781 ctgcccctga gccggagcgg acgcccgttg gcaggggtc ctgggcccac ccgggcagga
 841 cgcgtggacc gagtgaccgt ggtttctgtg tggtgtcacc tgccagaccc gccgaagaag
 901 ccacctcttt ggagggtgcg ctctctggca cgcgccactc ccacccatcc gtgggccgcc
 961 agcaccacgc gggccccca tccacatcgc ggccaccacg tccctgggac acgccttgtc
1021 ccccggtgta cgccgagacc aagcacttcc tctactcctc aggcgacaag gagcagctgc
1081 ggccctcctt cctactcagc tctctgaggc ccagcctgac tggcgctcgg aggctcgtgg
1141 agaccatctt tctgggttcc aggccctgga tgccagggac tccccgcagg ttgccccgcc
1201 tgccccagcg ctactggcaa atgcggcccc tgtttctgga gctgcttggg aaccacgcgc
1261 agtgccccta cggggtgctc ctcaagacgc actgcccgct gcgagctgcg gtcaccccag
1321 cagccggtgt ctgtgcccgg gagaagcccc agggctctgt ggcggcccc gaggaggagg
1381 acacagaccc ccgtcgcctg gtgcagctgc tccgccagca cagcagcccc tggcaggtgt
1441 acggcttcgt gcgggcctgc ctgcgccggc tggtgccccc aggcctctgg ggctccaggc
1501 acaacgaacg ccgcttcctc aggaacacca agaagttcat ctccctgggg aagcatgcca
1561 agctctcgct gcaggagctg acgtggaaga tgagcgtgcg gggctgcgct tggctgcgca
1621 ggagcccagg ggttggctgt gttccggccg cagagcaccg tctgcgtgag gagatcctgg
1681 ccaagttcct gcactggctg atgagtgtgt acgtcgtcga gctgctcagg tctttctttt
1741 atgtcacgga gaccacgttt caaaagaaca ggctcttttt ctaccggaag agtgtctgga
1801 gcaagttgca aagcattgga atcagacagc acttgaagag ggtgcagctg cgggagctgt
1861 cggaagcaga ggtcaggcag catcgggaag ccaggccgc cctgctgacg tccagactcc
1921 gcttcatccc caagcctgac gggctgcggc cgattgtgaa catggactac gtcgtgggag
1981 ccagaacgtt ccgcagagaa aagagggccg agcgtctcac ctcgagggtg aaggcactgt
2041 tcagcgtgct caactacgag cgggcgcggc gccccgccct cctgggcgcc tctgtgctgg
2101 gcctggacga tatccacagg gcctggcgca ccttcgtgct gcgtgtgcgg gcccaggacc
2161 cgccgcctga gctgtacttt gtcaaggtgg atgtgacggg cgcgtacgac accatccccc
2221 aggacaggct cacggaggtc atcgccagca tcatcaaacc ccagaacacg tactgcgtgc
2281 gtcggtatgc cgtggtccag aaggccgccc atgggcacgt ccgcaaggcc ttcaagagcc
2341 acgtctctac cttgacagac ctccagccgt acatgcgaca gttcgtggct cacctgcagg
```

```
-continued
2401 agaccagccc gctgagggat gccgtcgtca tcgagcagag ctcctccctg aatgaggcca 2461 gcagtggcct cttcgacgtc ttcctacgct tcatgtgcca ccacgccgtg cgcatcaggg 2521 gcaagtccta cgtccagtgc caggggatcc cgcagggctc catcctctcc acgctgctct 2581 gcagcctgtg ctacggcgac atggagaaca agctgtttgc ggggattcgg cgggacgggc 2641 tgctcctgcg tttggtggat gatttcttgt tggtgacacc tcacctcacc cacgcgaaaa 2701 ccttcctcag gaccctggtc cgaggtgtcc ctgagtatgg ctgcgtggtg aacttgcgga 2761 agacagtggt gaacttccct gtagaagacg aggccctggg tggcacggct tttgttcaga 2821 tgccggccca cggcctattc ccctggtgcg gctgctgct ggatacccgg accctggagg 2881 tgcagagcga ctactccagc tatgcccgga cctccatcag agccagtctc accttcaacc 2941 gcggcttcaa ggctgggagg aacatgcgtc gcaaactctt tggggtcttg cggctgaagt 3001 gtcacagcct gtttctggat ttgcaggtga acagcctcca gacggtgtgc accaacatct 3061 acaagatcct cctgctgcag gcgtacaggt ttcacgcatg tgtgctgcag ctcccatttc 3121 atcagcaagt ttggaagaac cccacatttt tcctgcgcgt catctctgac acggcctccc 3181 tctgctactc catcctgaaa gccaagaacg cagggatgtc gctgggggcc aagggcgccg 3241 ccggccctct gccctccgag gccgtgcagt ggctgtgcca ccaagcattc ctgctcaagc 3301 tgactcgaca ccgtgtcacc tacgtgccac tcctggggtc actcaggaca gcccagacgc 3361 agctgagtcg gaagctcccg gggacgacgc tgactgccct ggaggccgca gccaacccgg 3421 cactgccctc agacttcaag accatcctgg actgatggcc acccgcccac agccaggccg 3481 agagcagaca ccagcagccc tgtcacgccg ggctctacgt cccagggagg gaggggcggc 3541 ccacacccag gcccgcaccg ctgggagtct gaggcctgag tgagtgtttg gccgaggcct 3601 gcatgtccgc ctgaaggctg agtgtccggc tgaggcctga gcgagtgtcc agccaagggc 3661 tgagtgtcca gcacacctgc cgtcttcact tccccacagg ctggcgctcg gctccacccc 3721 agggccagct tttcctcacc aggagcccgg cttccactcc ccacatagga atagtccatc 3781 cccagattcg ccattgttca cccctcgccc tgccctcctt tgccttccac ccccaccatc 3841 caggtggaga ccctgagaag gaccctggga gctctgggaa tttggagtga ccaaaggtgt 3901 gccctgtaca caggcgagga ccctgcacct ggatgggggt ccctgtgggt caaattgggg 3961 ggaggtgctg tgggagtaaa atactgaata tatgagtttt tcagttttga aaaaaaaaa 4021 aaaaaaa
```

In an embodiment, the hTERT is encoded by a nucleic acid having a sequence at least 80%, 85%, 90%, 95%, 96, 97%, 98%, or 99% identical to the sequence of SEQ ID NO: 62. In an embodiment, the hTERT is encoded by a nucleic acid of SEQ ID NO: 62.

Activation and Expansion of Cells

Cells may be activated and expanded generally using methods as described, for example, in U.S. Pat. Nos. 6,352, 694; 6,534,055; 6,905,680; 6,692,964; 5,858,358; 6,887, 466; 6,905,681; 7,144,575; 7,067,318; 7,172,869; 7,232, 566; 7,175,843; 5,883,223; 6,905,874; 6,797,514; 6,867, 041; and U.S. Patent Application Publication No. 20060121005.

Generally, the T cells of the invention are expanded by contact with a surface having attached thereto an agent that stimulates a CD3/TCR complex associated signal and a ligand that stimulates a co-stimulatory molecule on the surface of the T cells. In particular, T cell populations may be stimulated as described herein, such as by contact with an anti-CD3 antibody, or antigen-binding fragment thereof, or an anti-CD2 antibody immobilized on a surface, or by contact with a protein kinase C activator (e.g., bryostatin) in conjunction with a calcium ionophore. For co-stimulation of an accessory molecule on the surface of the T cells, a ligand that binds the accessory molecule is used. For example, a population of T cells can be contacted with an anti-CD3 antibody and an anti-CD28 antibody, under conditions appropriate for stimulating proliferation of the T cells. To stimulate proliferation of either $CD4^+$ T cells or $CD8^+$ T cells, an anti-CD3 antibody and an anti-CD28 antibody. Examples of an anti-CD28 antibody include 9.3, B-T3, XR-CD28 (Diaclone, Besancon, France) can be used as can other methods commonly known in the art (Berg et al., *Transplant Proc.* 30(8):3975-3977, 1998; Haanen et al., *J. Exp. Med.* 190(9):13191328, 1999; Garland et al., *J. Immunol Meth.* 227(1-2):53-63, 1999).

In certain embodiments, the primary stimulatory signal and the co-stimulatory signal for the T cell may be provided by different protocols. For example, the agents providing each signal may be in solution or coupled to a surface. When coupled to a surface, the agents may be coupled to the same surface (i.e., in "cis" formation) or to separate surfaces (i.e., in "trans" formation). Alternatively, one agent may be coupled to a surface and the other agent in solution. In one embodiment, the agent providing the co-stimulatory signal is bound to a cell surface and the agent providing the primary activation signal is in solution or coupled to a surface. In certain embodiments, both agents can be in solution. In another embodiment, the agents may be in soluble form, and then cross-linked to a surface, such as a cell expressing Fc receptors or an antibody or other binding agent which will bind to the agents. In this regard, see for example, U.S. Patent Application Publication Nos. 20040101519 and 20060034810 for artificial antigen presenting cells (aAPCs) that are contemplated for use in activating and expanding T cells in the present invention.

In one embodiment, the two agents are immobilized on beads, either on the same bead, i.e., "cis," or to separate beads, i.e., "trans." By way of example, the agent providing the primary activation signal is an anti-CD3 antibody or an antigen-binding fragment thereof and the agent providing the co-stimulatory signal is an anti-CD28 antibody or antigen-binding fragment thereof; and both agents are co-immobilized to the same bead in equivalent molecular amounts. In one embodiment, a 1:1 ratio of each antibody bound to the beads for $CD4^+$ T cell expansion and T cell growth is used. In certain aspects of the present invention, a ratio of anti CD3:CD28 antibodies bound to the beads is used such that an increase in T cell expansion is observed as compared to the expansion observed using a ratio of 1:1. In one particular embodiment an increase of from about 1 to about 3 fold is observed as compared to the expansion observed using a ratio of 1:1. In one embodiment, the ratio of CD3:CD28 antibody bound to the beads ranges from 100:1 to 1:100 and all integer values there between. In one aspect of the present invention, more anti-CD28 antibody is bound to the particles than anti-CD3 antibody, i.e., the ratio of CD3:CD28 is less than one. In certain embodiments of the invention, the ratio of anti CD28 antibody to anti CD3 antibody bound to the beads is greater than 2:1. In one particular embodiment, a 1:100 CD3:CD28 ratio of antibody bound to beads is used. In another embodiment, a 1:75 CD3:CD28 ratio of antibody bound to beads is used. In a further embodiment, a 1:50 CD3:CD28 ratio of antibody bound to beads is used. In another embodiment, a 1:30 CD3:CD28 ratio of antibody bound to beads is used. In one preferred embodiment, a 1:10 CD3:CD28 ratio of antibody bound to beads is used. In another embodiment, a 1:3 CD3:CD28 ratio of antibody bound to the beads is used. In yet another embodiment, a 3:1 CD3:CD28 ratio of antibody bound to the beads is used.

Ratios of particles to cells from 1:500 to 500:1 and any integer values in between may be used to stimulate T cells or other target cells. As those of ordinary skill in the art can readily appreciate, the ratio of particles to cells may depend on particle size relative to the target cell. For example, small sized beads could only bind a few cells, while larger beads could bind many. In certain embodiments the ratio of cells to particles ranges from 1:100 to 100:1 and any integer values in-between and in further embodiments the ratio comprises 1:9 to 9:1 and any integer values in between, can also be used to stimulate T cells. The ratio of anti-CD3- and anti-CD28-coupled particles to T cells that result in T cell stimulation can vary as noted above, however certain preferred values include 1:100, 1:50, 1:40, 1:30, 1:20, 1:10, 1:9, 1:8, 1:7, 1:6, 1:5, 1:4, 1:3, 1:2, 1:1, 2:1, 3:1, 4:1, 5:1, 6:1, 7:1, 8:1, 9:1, 10:1, and 15:1 with one preferred ratio being at least 1:1 particles per T cell. In one embodiment, a ratio of particles to cells of 1:1 or less is used. In one particular embodiment, a preferred particle:cell ratio is 1:5. In further embodiments, the ratio of particles to cells can be varied depending on the day of stimulation. For example, in one embodiment, the ratio of particles to cells is from 1:1 to 10:1 on the first day and additional particles are added to the cells every day or every other day thereafter for up to 10 days, at final ratios of from 1:1 to 1:10 (based on cell counts on the day of addition). In one particular embodiment, the ratio of particles to cells is 1:1 on the first day of stimulation and adjusted to 1:5 on the third and fifth days of stimulation. In another embodiment, particles are added on a daily or every other day basis to a final ratio of 1:1 on the first day, and 1:5 on the third and fifth days of stimulation. In another embodiment, the ratio of particles to cells is 2:1 on the first day of stimulation and adjusted to 1:10 on the third and fifth days of stimulation. In another embodiment, particles are added on a daily or every other day basis to a final ratio of 1:1 on the first day, and 1:10 on the third and fifth days of stimulation. One of skill in the art will appreciate that a variety of other ratios may be suitable for use in the present invention. In particular, ratios will vary depending on particle size and on cell size and type. In one embodiment, the most typical ratios for use are in the neighborhood of 1:1, 2:1 and 3:1 on the first day.

In further embodiments of the present invention, the cells, such as T cells, are combined with agent-coated beads, the beads and the cells are subsequently separated, and then the cells are cultured. In an alternative embodiment, prior to culture, the agent-coated beads and cells are not separated but are cultured together. In a further embodiment, the beads and cells are first concentrated by application of a force, such as a magnetic force, resulting in increased ligation of cell surface markers, thereby inducing cell stimulation.

By way of example, cell surface proteins may be ligated by allowing paramagnetic beads to which anti-CD3 and anti-CD28 are attached (3×28 beads) to contact the T cells. In one embodiment the cells (for example, $10^4$ to $10^9$ T cells) and beads (for example, DYNABEADS® M-450 CD3/CD28 T paramagnetic beads at a ratio of 1:1) are combined in a buffer, for example PBS (without divalent cations such as, calcium and magnesium). Again, those of ordinary skill in the art can readily appreciate any cell concentration may be used. For example, the target cell may be very rare in the sample and comprise only 0.01% of the sample or the entire sample (i.e., 100%) may comprise the target cell of interest. Accordingly, any cell number is within the context of the present invention. In certain embodiments, it may be desirable to significantly decrease the volume in which particles and cells are mixed together (i.e., increase the concentration of cells), to ensure maximum contact of cells and particles. For example, in one embodiment, a concentration of about 2 billion cells/ml is used. In another embodiment, greater than 100 million cells/ml is used. In a further embodiment, a concentration of cells of 10, 15, 20, 25, 30, 35, 40, 45, or 50 million cells/ml is used. In yet another embodiment, a concentration of cells from 75, 80, 85, 90, 95, or 100 million cells/ml is used. In further embodiments, concentrations of 125 or 150 million cells/ml can be used. Using high concentrations can result in increased cell yield, cell activation, and cell expansion. Further, use of high cell concentrations allows more efficient capture of cells that may weakly express target antigens of interest, such as CD28-negative T cells. Such populations of cells may have therapeutic value and would be desirable to obtain in certain embodiments.

For example, using high concentration of cells allows more efficient selection of CD8+ T cells that normally have weaker CD28 expression.

In one embodiment, cells transduced with a nucleic acid encoding a CAR, e.g., a NKR-CAR described herein, are expanded, e.g., by a method described herein. In one embodiment, the cells are expanded in culture for a period of several hours (e.g., about 2, 3, 4, 5, 6, 7, 8, 9, 10, 15, 18, 21 hours) to about 14 days (e.g., 1, 2, 3, 4, 5, 6, 7, 8, 9, 10, 11, 12, 13 or 14 days). In one embodiment, the cells are expanded for a period of 4 to 9 days. In one embodiment, the cells are expanded for a period of 8 days or less, e.g., 7, 6 or 5 days. In one embodiment, the cells, e.g., a NKR-CAR cell described herein, are expanded in culture for 5 days, and the resulting cells are more potent than the same cells expanded in culture for 9 days under the same culture conditions. Potency can be defined, e.g., by various T cell functions, e.g. proliferation, target cell killing, cytokine production, activation, migration, or combinations thereof. In one embodiment, the cells, e.g., a NKR-CAR cell described herein, expanded for 5 days show at least a one, two, three or four fold increase in cells doublings upon antigen stimulation as compared to the same cells expanded in culture for 9 days under the same culture conditions. In one embodiment, the cells, e.g., the cells expressing a NKR-CAR described herein, are expanded in culture for 5 days, and the resulting cells exhibit higher proinflammatory cytokine production, e.g., IFN-γ and/or GM-CSF levels, as compared to the same cells expanded in culture for 9 days under the same culture conditions. In one embodiment, the cells, e.g., a NKR-CAR cell described herein, expanded for 5 days show at least a one, two, three, four, five, ten fold or more increase in pg/ml of proinflammatory cytokine production, e.g., IFN-γ and/or GM-CSF levels, as compared to the same cells expanded in culture for 9 days under the same culture conditions.

In one embodiment of the present invention, the mixture may be cultured for several hours (about 3 hours) to about 14 days or any hourly integer value in between. In another embodiment, the mixture may be cultured for 21 days. In one embodiment of the invention the beads and the T cells are cultured together for about eight days. In another embodiment, the beads and T cells are cultured together for 2-3 days. Several cycles of stimulation may also be desired such that culture time of T cells can be 60 days or more. Conditions appropriate for T cell culture include an appropriate media (e.g., Minimal Essential Media or RPMI Media 1640 or, X-vivo 15, (Lonza)) that may contain factors necessary for proliferation and viability, including serum (e.g., fetal bovine or human serum), interleukin-2 (IL-2), insulin, IFN-γ, IL-4, IL-7, GM-CSF, IL-10, IL-12, IL-15, TGFβ, and TNF-α or any other additives for the growth of cells known to the skilled artisan. Other additives for the growth of cells include, but are not limited to, surfactant, plasmanate, and reducing agents such as N-acetyl-cysteine and 2-mercaptoethanol. Media can include RPMI 1640, AIM-V, DMEM, MEM, α-MEM, F-12, X-Vivo 15, and X-Vivo 20, Optimizer, with added amino acids, sodium pyruvate, and vitamins, either serum-free or supplemented with an appropriate amount of serum (or plasma) or a defined set of hormones, and/or an amount of cytokine(s) sufficient for the growth and expansion of T cells. Antibiotics, e.g., penicillin and streptomycin, are included only in experimental cultures, not in cultures of cells that are to be infused into a subject. The target cells are maintained under conditions necessary to support growth, for example, an appropriate temperature (e.g., 37° C.) and atmosphere (e.g., air plus 5% $CO_2$).

In one embodiment, the cells are expanded in an appropriate media (e.g., media described herein) that includes one or more interleukin that result in at least a 200-fold (e.g., 200-fold, 250-fold, 300-fold, 350-fold) increase in cells over a 14 day expansion period, e.g., as measured by a method described herein such as flow cytometry. In one embodiment, the cells are expanded in the presence of IL-15 and/or IL-7 (e.g., IL-15 and IL-7).

In embodiments, methods described herein, e.g., CAR-expressing cell manufacturing methods, comprise removing T regulatory cells, e.g., CD25+ T cells, from a cell population, e.g., using an anti-CD25 antibody, or fragment thereof, or a CD25-binding ligand, IL-2. Methods of removing T regulatory cells, e.g., CD25+ T cells, from a cell population are described herein. In embodiments, the methods, e.g., manufacturing methods, further comprise contacting a cell population (e.g., a cell population in which T regulatory cells, such as CD25+ T cells, have been depleted; or a cell population that has previously contacted an anti-CD25 antibody, fragment thereof, or CD25-binding ligand) with IL-15 and/or IL-7. For example, the cell population (e.g., that has previously contacted an anti-CD25 antibody, fragment thereof, or CD25-binding ligand) is expanded in the presence of IL-15 and/or IL-7.

In some embodiments a CAR-expressing cell described herein is contacted with a composition comprising a interleukin-15 (IL-15) polypeptide, a interleukin-15 receptor alpha (IL-15Ra) polypeptide, or a combination of both a IL-15 polypeptide and a IL-15Ra polypeptide e.g., hetIL-15, during the manufacturing of the CAR-expressing cell, e.g., ex vivo. In embodiments, a CAR-expressing cell described herein is contacted with a composition comprising a IL-15 polypeptide during the manufacturing of the CAR-expressing cell, e.g., ex vivo. In embodiments, a CAR-expressing cell described herein is contacted with a composition comprising a combination of both a IL-15 polypeptide and a IL-15 Ra polypeptide during the manufacturing of the CAR-expressing cell, e.g., ex vivo. In embodiments, a CAR-expressing cell described herein is contacted with a composition comprising hetIL-15 during the manufacturing of the CAR-expressing cell, e.g., ex vivo.

In one embodiment the CAR-expressing cell described herein is contacted with a composition comprising hetIL-15 during ex vivo expansion. In an embodiment, the CAR-expressing cell described herein is contacted with a composition comprising an IL-15 polypeptide during ex vivo expansion. In an embodiment, the CAR-expressing cell described herein is contacted with a composition comprising both an IL-15 polypeptide and an IL-15Ra polypeptide during ex vivo expansion. In one embodiment the contacting results in the survival and proliferation of a lymphocyte subpopulation, e.g., CD8+ T cells.

T cells that have been exposed to varied stimulation times may exhibit different characteristics. For example, typical blood or apheresed peripheral blood mononuclear cell products have a helper T cell population ($T_H$, $CD4^+$) that is greater than the cytotoxic or suppressor T cell population ($T_C$, $CD8^+$). Ex vivo expansion of T cells by stimulating CD3ζ and CD28 receptors produces a population of T cells that prior to about days 8-9 consists predominately of $T_H$ cells, while after about days 8-9, the population of T cells comprises an increasingly greater population of $T_C$ cells. Accordingly, depending on the purpose of treatment, infusing a subject with a T cell population comprising predominately of $T_H$ cells may be advantageous. Similarly, if an antigen-specific subset of $T_C$ cells has been isolated it may be beneficial to expand this subset to a greater degree.

Further, in addition to CD4 and CD8 markers, other phenotypic markers vary significantly, but in large part, reproducibly during the course of the cell expansion process. Thus, such reproducibility enables the ability to tailor an activated T cell product for specific purposes.

Alternatively, or in combination to the methods disclosed herein, methods and compositions for one or more of: detection and/or quantification of CAR-expressing cells (e.g., in vitro or in vivo (e.g., clinical monitoring)); immune cell expansion and/or activation; and/or CAR-specific selection, that involve the use of a CAR ligand, are disclosed. In one exemplary embodiment, the CAR ligand is an antibody that binds to the CAR molecule, e.g., binds to the extracellular antigen binding domain of CAR (e.g., an antibody that binds to the antigen binding domain, e.g., an anti-idiotypic antibody; or an antibody that binds to a constant region of the extracellular binding domain). In other embodiments, the CAR ligand is a CAR antigen molecule (e.g., a CAR antigen molecule as described herein).

In one aspect, a method for detecting and/or quantifying CAR-expressing cells is disclosed. For example, the CAR ligand can be used to detect and/or quantify CAR-expressing cells in vitro or in vivo (e.g., clinical monitoring of CAR-expressing cells in a patient, or dosing a patient). The method includes:

providing the CAR ligand (optionally, a labelled CAR ligand, e.g., a CAR ligand that includes a tag, a bead, a radioactive or fluorescent label);

acquiring the CAR-expressing cell (e.g., acquiring a sample containing CAR-expressing cells, such as a manufacturing sample or a clinical sample);

contacting the CAR-expressing cell with the CAR ligand under conditions where binding occurs, thereby detecting the level (e.g., amount) of the CAR-expressing cells present. Binding of the CAR-expressing cell with the CAR ligand can be detected using standard techniques such as FACS, ELISA and the like.

In another aspect, a method of expanding and/or activating cells (e.g., immune effector cells) is disclosed. The method includes:

providing a CAR-expressing cell (e.g., a first CAR-expressing cell or a transiently expressing CAR cell);

contacting said CAR-expressing cell with a CAR ligand, e.g., a CAR ligand as described herein), under conditions where immune cell expansion and/or proliferation occurs, thereby producing the activated and/or expanded cell population.

In certain embodiments, the CAR ligand is present on (e.g., is immobilized or attached to a substrate, e.g., a non-naturally occurring substrate). In some embodiments, the substrate is a non-cellular substrate. The non-cellular substrate can be a solid support chosen from, e.g., a plate (e.g., a microtiter plate), a membrane (e.g., a nitrocellulose membrane), a matrix, a chip or a bead. In embodiments, the CAR ligand is present in the substrate (e.g., on the substrate surface). The CAR ligand can be immobilized, attached, or associated covalently or non-covalently (e.g., cross-linked) to the substrate. In one embodiment, the CAR ligand is attached (e.g., covalently attached) to a bead. In the aforesaid embodiments, the immune cell population can be expanded in vitro or ex vivo. The method can further include culturing the population of immune cells in the presence of the ligand of the CAR molecule, e.g., using any of the methods described herein.

In other embodiments, the method of expanding and/or activating the cells further comprises addition of a second stimulatory molecule, e.g., CD28. For example, the CAR ligand and the second stimulatory molecule can be immobilized to a substrate, e.g., one or more beads, thereby providing increased cell expansion and/or activation.

In yet another aspect, a method for selecting or enriching for a CAR expressing cell is provided. The method includes contacting the CAR expressing cell with a CAR ligand as described herein; and selecting the cell on the basis of binding of the CAR ligand.

In yet other embodiments, a method for depleting, reducing and/or killing a CAR expressing cell is provided. The method includes contacting the CAR expressing cell with a CAR ligand as described herein; and targeting the cell on the basis of binding of the CAR ligand, thereby reducing the number, and/or killing, the CAR-expressing cell. In one embodiment, the CAR ligand is coupled to a toxic agent (e.g., a toxin or a cell ablative drug). In another embodiment, the anti-idiotypic antibody can cause effector cell activity, e.g., ADCC or ADC activities.

Exemplary anti-CAR antibodies that can be used in the methods disclosed herein are described, e.g., in WO 2014/190273 and by Jena et al., "Chimeric Antigen Receptor (CAR)-Specific Monoclonal Antibody to Detect CD19-Specific T cells in Clinical Trials", PLOS March 2013 8:3 e57838, the contents of which are incorporated by reference. In one embodiment, the anti-idiotypic antibody molecule recognizes an anti-CD19 antibody molecule, e.g., an anti-CD19 scFv. For instance, the anti-idiotypic antibody molecule can compete for binding with the CD19-specific CAR mAb clone no. 136.20.1 described in Jena et al., PLOS March 2013 8:3 e57838; may have the same CDRs (e.g., one or more of, e.g., all of, VH CDR1, VH CDR2, CH CDR3, VL CDR1, VL CDR2, and VL CDR3, using the Kabat definition, the Chothia definition, or a combination of the Kabat and Chothia definitions) as the CD19-specific CAR mAb clone no. 136.20.1; may have one or more (e.g., 2) variable regions as the CD19-specific CAR mAb clone no. 136.20.1, or may comprise the CD19-specific CAR mAb clone no. 136.20.1. In some embodiments, the anti-idiotypic antibody was made according to a method described in Jena et al. In another embodiment, the anti-idiotypic antibody molecule is an anti-idiotypic antibody molecule described in WO 2014/190273. In some embodiments, the anti-idiotypic antibody molecule has the same CDRs (e.g., one or more of, e.g., all of, VH CDR1, VH CDR2, CH CDR3, VL CDR1, VL CDR2, and VL CDR3) as an antibody molecule of WO 2014/190273 such as 136.20.1; may have one or more (e.g., 2) variable regions of an antibody molecule of WO 2014/190273, or may comprise an antibody molecule of WO 2014/190273 such as 136.20.1. In other embodiments, the anti-CAR antibody binds to a constant region of the extracellular binding domain of the CAR molecule, e.g., as described in WO 2014/190273. In some embodiments, the anti-CAR antibody binds to a constant region of the extracellular binding domain of the CAR molecule, e.g., a heavy chain constant region (e.g., a CH2-CH3 hinge region) or light chain constant region. For instance, in some embodiments the anti-CAR antibody competes for binding with the 2D3 monoclonal antibody described in WO 2014/190273, has the same CDRs (e.g., one or more of, e.g., all of, VH CDR1, VH CDR2, CH CDR3, VL CDR1, VL CDR2, and VL CDR3) as 2D3, or has one or more (e.g., 2) variable regions of 2D3, or comprises 2D3 as described in WO 2014/190273.

In some aspects and embodiments, the compositions and methods herein are optimized for a specific subset of T cells, e.g., as described in U.S. Ser. No. 62/031,699 filed Jul. 31, 2014, the contents of which are incorporated herein by reference in their entirety. In some embodiments, the optimized subsets of T cells display an enhanced persistence compared to a control T cell, e.g., a T cell of a different type (e.g., CD8$^+$ or CD4$^+$) expressing the same construct.

In some embodiments, a CD4$^+$ T cell comprises a CAR described herein, which CAR comprises an intracellular signaling domain suitable for (e.g., optimized for, e.g., leading to enhanced persistence in) a CD4$^+$ T cell, e.g., an ICOS domain. In some embodiments, a CD8$^+$ T cell comprises a CAR described herein, which CAR comprises an intracellular signaling domain suitable for (e.g., optimized for, e.g., leading to enhanced persistence of) a CD8$^+$ T cell, e.g., a 4-1BB domain, a CD28 domain, or another costimulatory domain other than an ICOS domain. In some embodiments, the CAR described herein comprises an antigen binding domain described herein, e.g., a CAR comprising an antigen binding domain that specifically binds to a tumor antigen described herein.

In an aspect, described herein is a method of treating a subject, e.g., a subject having cancer. The method includes administering to said subject, an effective amount of:

1) a CD4$^+$ T cell comprising a CAR (the CAR$^{CD4+}$) comprising:
  an antigen binding domain, e.g., an antigen binding domain described herein, e.g., an antigen binding domain that specifically binds a tumor antigen described herein;
  a transmembrane domain; and
  an intracellular signaling domain, e.g., a first costimulatory domain, e.g., an ICOS domain; and 2) a CD8$^+$ T cell comprising a CAR (the CAR$^{CD8+}$) comprising:
  an antigen binding domain, e.g., an antigen binding domain described herein, e.g., an antigen binding domain that specifically binds a tumor antigen described herein;
  a transmembrane domain; and
  an intracellular signaling domain, e.g., a second costimulatory domain, e.g., a 4-1BB domain, a CD28 domain, or another costimulatory domain other than an ICOS domain;
  wherein the CAR$^{CD4+}$ and the CAR$^{CD8+}$ differ from one another.

Optionally, the method further includes administering:

3) a second CD8+ T cell comprising a CAR (the second CAR$^{CD8+}$) comprising:
  an antigen binding domain, e.g., an antigen binding domain described herein, e.g., an antigen binding domain that specifically binds a tumor antigen described herein;
  a transmembrane domain; and
  an intracellular signaling domain, wherein the second CAR$^{CD8+}$ comprises an intracellular signaling domain, e.g., a costimulatory signaling domain, not present on the CAR$^{CD8+}$, and, optionally, does not comprise an ICOS signaling domain.

Assays for CAR Activity

Once a CAR, e.g., a NKR-CAR, described herein is constructed, various assays can be used to evaluate the activity of the molecule, such as but not limited to, the ability to expand T cells following antigen stimulation, sustain T cell expansion in the absence of re-stimulation, and anti-cancer activities in appropriate in vitro and animal models. Assays to evaluate the effects of a NKR-CAR are described in further detail below.

Western blot analysis of NKR-CAR expression in primary T cells can be used to detect the presence of monomers and dimers. See, e.g., Milone et al., Molecular Therapy 17(8): 1453-1464 (2009). Very briefly, T cells (1:1 mixture of CD4$^+$ and CD8$^+$ T cells) expressing the CARs are expanded in vitro for more than 10 days followed by lysis and SDS-PAGE under reducing conditions. CARs are detected by western blotting using an antibody specific to components of the CAR, e.g., an NKR component, e.g., a KIR component. The same T cell subsets are used for SDS-PAGE analysis under non-reducing conditions to permit evaluation of covalent dimer formation.

In vitro expansion of CAR$^+$ T cells following antigen stimulation can be measured by flow cytometry. For example, a mixture of CD4$^+$ and CD8$^+$ T cells are stimulated with αCD3/αCD28 aAPCs followed by transduction with lentiviral vectors expressing GFP under the control of the promoters to be analyzed. Exemplary promoters include the CMV IE gene, EF-1α, ubiquitin C, or phosphoglycerokinase (PGK) promoters. GFP fluorescence is evaluated on day 6 of culture in the CD4$^+$ and/or CD8$^+$ T cell subsets by flow cytometry. See, e.g., Milone et al., Molecular Therapy 17(8): 1453-1464 (2009). Alternatively, a mixture of CD4$^+$ and CD8$^+$ T cells are stimulated with αCD3/αCD28 coated magnetic beads on day 0, and transduced with CAR on day 1 using a bicistronic lentiviral vector expressing CAR along with eGFP using a 2A ribosomal skipping sequence. Cultures are re-stimulated with either tumor antigen-expressing K562 cells, wild-type K562 cells (K562 wild type) or negative control cells that do not express the tumor antigen. Exogenous IL-2 is added to the cultures every other day at 100 IU/ml. GFP$^+$ T cells are enumerated by flow cytometry using bead-based counting. See, e.g., Milone et al., Molecular Therapy 17(8): 1453-1464 (2009).

Sustained CAR$^+$ T cell expansion in the absence of re-stimulation can also be measured. See, e.g., Milone et al., Molecular Therapy 17(8): 1453-1464 (2009). Briefly, mean T cell volume (fl) is measured on day 8 of culture using a Coulter Multisizer III particle counter, a Nexcelom Cellometer Vision or Millipore Scepter, following stimulation with αCD3/αCD28 coated magnetic beads on day 0, and transduction with the indicated CAR on day 1.

Animal models can also be used to measure activity of a CAR-expressing cell. For example, xenograft model using human mesothelin-specific KIR-CAR$^+$ T cells to treat a primary human cancer that expresses mesothelin, e.g., mesothelioma or ovarian cancer, in immunodeficient mice can be used. See, e.g., Milone et al., Molecular Therapy 17(8): 1453-1464 (2009). Very briefly, after establishment of the tumor, mice are randomized as to treatment groups. Different numbers of CAR-expressing T cells are administered. CAR-expression and proliferation/persistence of CAR-expressing cells can be monitored at various timepoints. Animals are assessed for tumor progression at weekly intervals. Survival curves for the groups are compared using the log-rank test. Dose dependent CAR treatment response can be evaluated. See, e.g., Milone et al., Molecular Therapy 17(8): 1453-1464 (2009).

Assessment of cell proliferation and cytokine production of CAR-expressing cells has been previously described, e.g., at Milone et al., Molecular Therapy 17(8): 1453-1464 (2009). Briefly, assessment of CAR-mediated proliferation is performed in microtiter plates by mixing washed T cells with K562 cells expressing CD19 (K19) or CD32 and CD137 (KT32-BBL) for a final T-cell:K562 ratio of 2:1. K562 cells are irradiated with gamma-radiation prior to use. Anti-CD3 (clone OKT3) and anti-CD28 (clone 9.3) monoclonal antibodies are added to cultures with KT32-BBL cells to serve as a positive control for stimulating T-cell proliferation since these signals support long-term CD8+ T cell expansion ex vivo. T cells are enumerated in cultures using CountBright™ fluorescent beads (Invitrogen, Carlsbad, Calif.) and flow cytometry as described by the manufacturer. CAR+ T cells are identified by GFP expression using T cells that are engineered with eGFP-2A linked CAR-expressing lentiviral vectors. For CAR+ T cells not expressing GFP, the CAR+ T cells are detected with biotinylated recombinant tumor-antigen protein and a secondary avidin-PE conjugate. CD4+ and CD8+ expression on T cells are also simultaneously detected with specific monoclonal antibodies (BD Biosciences). Cytokine measurements are performed on supernatants collected 24 hours following re-stimulation using the human TH1/TH2 cytokine cytometric bead array kit (BD Biosciences, San Diego, Calif.) according the manufacturer's instructions or using a Luminex 30-plex kit (Invitrogen). Fluorescence is assessed using a BD Fortessa flow cytometer, and data is analyzed according to the manufacturer's instructions. Similar experiments can be done with CD123 CARTS.

Cytotoxicity can be assessed by a standard 51Cr-release assay. See, e.g., Milone et al., Molecular Therapy 17(8): 1453-1464 (2009). Briefly, target cells (K562 lines expressing the tumor antigen and primary tumor cells) are loaded with 51Cr (as NaCrO4, New England Nuclear, Boston, Mass.) at 37° C. for 2 hours with frequent agitation, washed twice in complete RPMI and plated into microtiter plates. Effector T cells are mixed with target cells in the wells in complete RPMI at varying ratios of effector cell:target cell (E:T). Additional wells containing media only (spontaneous release, SR) or a 1% solution of triton-X 100 detergent (total release, TR) are also prepared. After 4 hours of incubation at 37° C., supernatant from each well is harvested. Released 51Cr is then measured using a gamma particle counter (Packard Instrument Co., Waltham, Mass.). Each condition is performed in at least triplicate, and the percentage of lysis is calculated using the formula: % Lysis=(ER−SR)/(TR−SR), where ER represents the average 51Cr released for each experimental condition.

Imaging technologies can be used to evaluate specific trafficking and proliferation of CARs in tumor-bearing animal models. Such assays have been described, for example, in Barrett et al., Human Gene Therapy 22:1575-1586 (2011). Briefly, NOD/SCID/γc−/− (NSG) mice are injected IV with Nalm-6 cells followed 7 days later with T cells 4 hour after electroporation with the CAR constructs. The T cells are stably transfected with a lentiviral construct to express firefly luciferase, and mice are imaged for bioluminescence. Alternatively, therapeutic efficacy and specificity of a single injection of CAR+ T cells in Nalm-6 xenograft model can be measured as the following: NSG mice are injected with Nalm-6 transduced to stably express firefly luciferase, followed by a single tail-vein injection of T cells electroporated with CAR 7 days later. Animals are imaged at various time points post injection. For example, photon-density heat maps of firefly luciferasepositive leukemia in representative mice at day 5 (2 days before treatment) and day 8 (24 hr post CAR+ PBLs) can be generated.

Other assays, including those described in the Example section herein as well as those that are known in the art can also be used to evaluate the CAR constructs of the invention.
Therapeutic Application The present invention encompasses a cell (e.g., T cell or NK cell) modified to express a NKR-CAR, e.g., a KIR-CAR, or a plurality of types of NKR-CARs, e.g., KIR-CARs, wherein each NKR-CAR, e.g., KIR-CAR, combines an antigen recognition domain of a specific antibody with a component of a NKR, e.g., a KIR.

In one embodiment, the KIR-CARs of the invention comprise an activating KIR which delivers its signal through an interaction with the immunotyrosine-based activation motif (ITAM) containing membrane protein, DAP12 that is mediated by residues within the transmembrane domains of these proteins.

In one embodiment, the KIR-CARs of the invention comprise an inhibitory KIR which delivers its signal through one or more immunotyrosine-based inhibitory motifs (ITIMs) that interact directly or indirectly with cytoplasmic signaling proteins such as SHP-1, SHP-2 and Vav family of proteins. KIRs bearing cytoplasmic domains that contain (ITIMs) abrogate the activating signal leading to inhibition of NK cytolytic and cytokine producing activity. In some instances, the modified T cell expressing a KIR-CAR of the invention can elicit a KIR-CAR-mediated T-cell response. In one embodiment, the dependence of the binding to more than one type of antigen allows the modified T cell to exhibit a heightened specificity to elicit a response upon binding of a tumor cell rather than a normal bystander cell.

The invention provides the use of a plurality of types of KIR-CARs to redirect the specificity of a primary T cell to a tumor antigen. Thus, the present invention also provides a method for stimulating a T cell-mediated immune response to a target cell population or tissue in a mammal comprising the step of administering to the mammal a T cell that expresses a plurality of types of KIR-CARs, wherein each type of KIR-CAR comprises a binding moiety that specifically interacts with a predetermined target. In one embodiment, the cell comprises a first KIR-CAR comprising an activating KIR (actKIR-CAR), and a second KIR-CAR comprising an inhibitory KIR (inhKIR-CAR).

Without wishing to be bound by any particular theory, the anti-tumor immunity response elicited by the KIR-CAR-modified T cells may be an active or a passive immune response. In addition, the KIR-CAR mediated immune response may be part of an adoptive immunotherapy approach in which KIR-CAR-modified T cells induce an immune response specific to the antigen binding domain in the KIR-CAR.

Cancers that may be treated include tumors that are not vascularized, or not yet substantially vascularized, as well as vascularized tumors. The cancers may comprise non-solid tumors (such as hematological tumors, for example, leukemias and lymphomas) or may comprise solid tumors. Types of cancers to be treated with the CARs of the invention include, but are not limited to, carcinoma, blastoma, and sarcoma, and certain leukemia or lymphoid malignancies, benign and malignant tumors, and malignancies e.g., sarcomas, carcinomas, and melanomas. Adult tumors/cancers and pediatric tumors/cancers are also included. In one embodiment, the cancer to be treated in a solid tumor, e.g., a solid tumor described herein.

Hematologic cancers are cancers of the blood or bone marrow. Examples of hematological (or hematogenous) cancers include leukemias, including acute leukemias (such as acute lymphocytic leukemia, acute myelocytic leukemia, acute myelogenous leukemia and myeloblastic, promyelocytic, myelomonocytic, monocytic and erythroleukemia), chronic leukemias (such as chronic myelocytic (granulocytic) leukemia, chronic myelogenous leukemia, and chronic lymphocytic leukemia), polycythemia vera, lymphoma, Hodgkin's disease, non-Hodgkin's lymphoma (indolent and high grade forms), multiple myeloma, Waldenstrom's macroglobulinemia, heavy chain disease, myelodysplastic syndrome, hairy cell leukemia and myelodysplasia.

Solid tumors are abnormal masses of tissue that usually do not contain cysts or liquid areas. Solid tumors can be benign or malignant. Different types of solid tumors are named for the type of cells that form them (such as sarcomas, carcinomas, and lymphomas). Examples of solid tumors, such as sarcomas and carcinomas, include fibrosarcoma, myxosarcoma, liposarcoma, chondrosarcoma, osteosarcoma, and other sarcomas, synovioma, mesothelioma, Ewing's tumor, leiomyosarcoma, rhabdomyosarcoma, colon carcinoma, lymphoid malignancy, pancreatic cancer, breast cancer, lung cancers, ovarian cancer, prostate cancer, hepatocellular carcinoma, squamous cell carcinoma, basal cell carcinoma, adenocarcinoma, sweat gland carcinoma, medullary thyroid carcinoma, papillary thyroid carcinoma, pheochromocytomas sebaceous gland carcinoma, papillary carcinoma, papillary adenocarcinomas, medullary carcinoma, bronchogenic carcinoma, renal cell carcinoma, hepatoma, bile duct carcinoma, choriocarcinoma, Wilms' tumor, cervical cancer, testicular tumor, seminoma, bladder carcinoma, melanoma, and CNS tumors (such as a glioma (such as brainstem glioma and mixed gliomas), glioblastoma (also known as glioblastoma multiforme) astrocytoma, CNS lymphoma, germinoma, medulloblastoma, Schwannoma craniopharyogioma, ependymoma, pinealoma, hemangioblastoma, acoustic neuroma, oligodendroglioma, menangioma, neuroblastoma, retinoblastoma and brain metastases).

In one embodiment, the disclosure provides methods of treating cancer by providing to the subject in need thereof immune effector cells (e.g., T cells, NK cells) that are engineered to express CD19 CAR, e.g., with an anti-CD19 binding domain described herein, wherein the cancer cells express CD19. In one embodiment, the cancer to be treated is ALL (acute lymphoblastic leukemia), CLL (chronic lymphocytic leukemia), DLBCL (diffuse large B-cell lymphoma), MCL (Mantle cell lymphoma, or MM (multiple myeloma).

In one embodiment, the disclosure provides methods of treating cancer by providing to the subject in need thereof immune effector cells (e.g., T cells, NK cells) that are engineered to express a EGFRvIIICAR, e.g., with an anti-EGRFvIII binding domain dscribed herein, wherein the cancer cells express EGFRvIII. In one embodiment, the cancer to be treated is glioblastoma.

In one embodiment, the disclosure provides methods of treating cancer by providing to the subject in need thereof immune effector cells (e.g., T cells, NK cells) that are engineered to express a mesothelin CAR, e.g., with an anti-mesothelin binding domain described herein, wherein the cancer cells express mesothelin. In one embodiment, the cancer to be treated is a solid tumor, e.g., a solid tumor described herein, e.g., mesothelioma, pancreatic cancer, lung cancer or ovarian cancer.

In one embodiment, the disclosure provides methods of treating cancer by providing to the subject in need thereof immune effector cells (e.g., T cells, NK cells) that are engineered to express a CD123CAR, e.g., with an anti-CD123 binding domain described herein, wherein the cancer cells express CD123. In one embodiment, the cancer to be treated is AML.

In one embodiment, the disclosure provides methods of treating cancer by providing to the subject in need thereof immune effector cells (e.g., T cells, NK cells) that are engineered to express a CLL-1CAR, e.g., with an anti-CLL-1 binding domain described herein, wherein the cancer cells express CLL-1. In one embodiment, the cancer to be treated is AML.

In one embodiment, the disclosure provides methods of treating cancer by providing to the subject in need thereof immune effector cells (e.g., T cells, NK cells) that are engineered to express a CD33CAR, e.g., with an anti-CD33 binding domain described herein, wherein the cancer cells express CD33. In one embodiment, the cancer to be treated is AML.

In one embodiment, the disclosure provides methods of treating cancer by providing to the subject in need thereof immune effector cells (e.g., T cells, NK cells) that are engineered to express a GD2CAR, e.g., with an anti-GD2 binding domain described herein, wherein the cancer cells express GD2. In one embodiment, the cancer to be treated is neuroblastoma.

In one embodiment, the disclosure provides methods of treating cancer by providing to the subject in need thereof immune effector cells (e.g., T cells, NK cells) that are engineered to express an o-acetyl-GD2CAR, wherein the cancer cells express o-acetyl-GD2. In one embodiment, the cancer to be treated is neuroblastoma, or melanoma.

In one embodiment, the disclosure provides methods of treating cancer by providing to the subject in need thereof immune effector cells (e.g., T cells, NK cells) that are engineered to express a BCMACAR, e.g., with an anti-BCMA binding domain described herein, wherein the cancer cells express BCMA. In one embodiment, the cancer to be treated is multiple myeloma.

In one embodiment, the disclosure provides methods of treating cancer by providing to the subject in need thereof immune effector cells (e.g., T cells, NK cells) that are engineered to express a CLDN6CAR, e.g., with an anti-CLDN6 binding domain described herein, wherein the cancer cells express CLDN6. In one embodiment, the cancer to be treated is a solid tumor, e.g., a solid tumor described herein, e.g., ovarian cancer, lung cancer, or breast cancer.

In one embodiment, the disclosure provides methods of treating cancer by providing to the subject in need thereof immune effector cells (e.g., T cells, NK cells) that are engineered to express a WT1CAR, e.g., with an anti-WT1 binding domain described herein, wherein the cancer cells express WT1.

In one embodiment, the antigen binding domain of the KIR-CAR cells, e.g., T cells or NK cells, of the invention is designed to treat a particular cancer. In one embodiment, the KIR-CAR cells, e.g., T cells or NK cells, of the invention are modified to express a first actKIR-CAR targeting a first antigen and a second inhKIR-CAR targeting a second antigen, where the first antigen is expressed on a particular tumor or cancer and the second antigen is not expressed on a particular tumor or cancer. In this manner, conditional activation of T cells is generated by engagement of actKIR-CAR (or standard TCR-zeta CAR bearing a scFv to an antigen on the malignant cell of interest) and the inhKIR-CAR bearing for example a scFv directed against an antigen that is present on normal, but not malignant tissue provides inhibition of the activating signal from the actKIR-CAR when the KIR-CAR T cell encounters normal cells. Examples of antigens that serve as useful targets for inhibitory CARs include the ephrin receptors (Pasquale, 2010, Nat Rev Cancer 10(3):165-80) and claudins (Singh et al., 2010, J Oncol, 2010:541957), which are expressed by epithelial cells from normal tissues, but often selectively lost by cancers (e.g. EPHA7).

Therapeutic Applications for Mesothelin-Expressing Diseases and Disorders

The present invention provides compositions and methods for treating diseases and disorders associated with expression of mesothelin. Examples of a disease or disorder associated with mesothelin expression include mesothelioma (e.g., pleural mesothelioma, peritoneal mesothelioma, pericardial mesothelioma), pancreatic cancer, or ovarian cancer. The disease or disorder associated with mesothelin expression is a solid tumor described herein.

Malignant mesothelioma is a type of cancer that occurs in the thin layer of cells lining the body's internal organs, known as the mesothelium. There are three recognized types of mesothelioma. Pleural mesothelioma (e.g., malignant pleural mesothelioma, or MPM) is the most common form of the disease, accounting for roughly 70% of cases, and occurs in the lining of the lung known as the pleura. Peritoneal mesothelioma occurs in the lining of the abdominal cavity, known as the peritoneum. Pericardial mesothelioma originates in the pericardium, which lines the heart.

A subject may be at risk to develop mesothelioma if the subject was exposed to asbestos. Exposure to asbestos and the inhalation of asbestos particles can cause mesothelioma. In most cases, mesothelioma symptoms will not appear in a subject exposed to asbestos until many years after the exposure has occurred.

Symptoms of pleural mesothelioma include, e.g., lower back pain or side chest pain, and shortness of breath. Other symptoms include difficulty swallowing, persistent cough, fever, weight loss or fatigue. Additional symptoms that some patients experience are muscle weakness, loss of sensory capability, coughing up blood, facial and arm swelling, and hoarseness. In the early stages of the disease, such as stage 1 mesothelioma, symptoms may be mild. Patients usually report pain in one area of the chest that never seems to go away, weight loss and fever.

Peritoneal mesothelioma originates in the abdomen and as a result, symptoms often include abdominal pain, weight loss, nausea, and vomiting. Fluid buildup may occur in the abdomen as well as a result of the cancer. Peritoneal mesothelioma originates in the abdomen and will frequently spread to other organs in area including the liver, spleen or bowel. Severe abdominal pain is the most common complaint that patients first experience. There may also be a discomfort level with fluid buildup in the abdomen as well. Other symptoms of peritoneal mesothelioma may include difficult bowel movements, nausea and vomiting, fever and swollen feet.

Pericardial mesothelioma is the least common form of mesothelioma. Pericardial mesothelioma, as the name suggests, involves the heart. This rare type of mesothelioma cancer invades the pericardium, the sac that surrounds the heart. As the cancer progresses, the heart is not able to deliver oxygen as efficiently to the body causing further decline in health at an increasingly rapid rate. The symptoms most commonly associated with pericardial mesothelioma mimic those of a heart attack: nausea, pain in the chest and shortness of breath.

Subjects benefiting from treatment according to the invention include subjects with a mesothelioma, or subjects suspected of having mesothelioma, e.g., as evidenced by the presence of one or more of the symptoms described herein and/or exposure to asbestos. In particular embodiments, the mesothelioma is pleural mesothelioma (e.g., malignant pleural mesothelioma). In other aspects, the subject may be treated that has a precancerous condition such as, e.g., pleural plaques, benign mesothelioma or mesothelial hyperplasia.

Another example of a disease or disorder associated with mesothelin is pancreatic cancer. Pancreatic cancers that can be treated with methods described herein include, but are not limited to, exocrine pancreatic cancers and endocrine pancreatic cancers. Exocrine pancreatic cancers include, but are not limited to, adenocarcinomas, acinar cell carcinomas, adenosquamous carcinomas, colloid carcinomas, undifferentiated carcinomas with osteoclast-like giant cells, hepatoid carcinomas, intraductal papillary-mucinous neoplasms, mucinous cystic neoplasms, pancreatoblastomas, serous cystadenomas, signet ring cell carcinomas, solid and pseuodpapillary tumors, pancreatic ductal carcinomas, and undifferentiated carcinomas. In some embodiments, the exocrine pancreatic cancer is pancreatic ductal carcinoma. Endocrine pancreatic cancers include, but are not limited to, insulinomas and glucagonomas.

In some embodiments, the pancreatic cancer is any of early stage pancreatic cancer, non-metastatic pancreatic cancer, primary pancreatic cancer, resected pancreatic cancer, advanced pancreatic cancer, locally advanced pancreatic cancer, metastatic pancreatic cancer, unresectable pancreatic cancer, pancreatic cancer in remission, recurrent pancreatic cancer, pancreatic cancer in an adjuvant setting, or pancreatic cancer in a neoadjuvant setting. In some embodiments, the pancreatic cancer is locally advanced pancreatic cancer, unresectable pancreatic cancer, or metastatic pancreatic ductal carcinoma. In some embodiments, the pancreatic cancer is resistant to the gemcitabine-based therapy. In some embodiments, the pancreatic cancer is refractory to the gemcitabine-based therapy.

In other aspects, the disorder associated with mesothelin expression is ovarian cancer. Ovarian cancer is classified according to the histology of the tumor. Surface epithelial-stromal tumor, also known as ovarian epithelial carcinoma, is the most common type of ovarian cancer. It includes serous tumor (including serous papillary cystadenocarcinoma), endometrioid tumor and mucinous cystadenocarcinoma.

The methods described herein can be used to treat various stages of ovarian cancer, e.g., stage I, stage II, stage III or stage IV. Staging can be performed, e.g., when the ovarian cancer is removed. Ovarian cancer is staged as follows:

Stage I cancer is confined to one or both ovaries. The cancer is stage II if either one or both of the ovaries is involved and has spread to the uterus and/or the fallopian tubes or other sites in the pelvis. The cancer is stage III cancer if one or both of the ovaries is involved and has spread to lymph nodes or other sites outside of the pelvis but is still within the abdominal cavity, such as the surface of the intestine or liver. The cancer is stage IV cancer if one or both ovaries are involved and the cancer has spread outside the abdomen or to the inside of the liver.

In some embodiments, the ovarian cancer is resistant to one or more chemotherapeutic agent. In some embodiments, the ovarian cancer is refractory to the one or more chemotherapeutic agent.

Other cancers that can be treated with the CAR compositions described herein include, e.g., brain cancer, bladder cancer, breast cancer, cervical cancer, colorectal cancer, liver cancer, kidney cancer, lymphoma, leukemia, lung cancer (e.g., lung adenocarcinoma), melanoma, metastatic melanoma, mesothelioma, neuroblastoma, ovarian cancer, prostate cancer, pancreatic cancer, renal cancer, skin cancer, thymoma, sarcoma, non-Hodgkin's lymphoma, Hodgkin's lymphoma, uterine cancer, and any combination thereof.

The present invention provides methods for inhibiting the proliferation or reducing a mesothelin-expressing cell population, the methods comprising contacting a population of cells comprising a mesothelin expressing cell with a mesothelin CAR-expressing cell of the invention that binds to the mesothelin-expressing cell. In a specific embodiment, the invention provides methods for inhibiting the proliferation or reducing the population of cancer cells expressing mesothelin, the methods comprising contacting the mesothelin-expressing cancer cell population with a mesothelin CAR-expressing cell of the invention that binds to the mesothelin-expressing cell. In another embodiment, the invention provides methods for inhibiting the proliferation or reducing the population of cancer cells expressing mesothelin, the methods comprising contacting the mesothelin-expressing cancer cell population with a mesothelin CAR-expressing cell of the invention that binds to the mesothelin-expressing cell. In certain embodiments, the mesothelin CAR-expressing cell of the invention reduces the quantity, number, amount or percentage of cells and/or cancer cells by at least 25%, at least 30%, at least 40%, at least 50%, at least 65%, at least 75%, at least 85%, at least 95%, or at least 99% in a subject with or animal model of mesothelioma or another cancer associated with mesothelin-expressing cells relative to a negative control. In one aspect, the subject is a human.

The invention also provides methods for preventing, treating and/or managing a disorder associated with mesothelin-expressing cells (e.g., mesothelioma), the methods comprising administering to a subject in need a mesothelioma CAR-expressing cell of the invention that binds to the mesothelin-expressing cell. In one aspect, the subject is a human.

The invention provides methods for preventing relapse of cancer associated with mesothelin-expressing cells, the methods comprising administering to a subject in need thereof a mesothelin CAR-expressing cell of the invention that binds to the mesothelin-expressing cell. In another embodiment, the methods comprise administering to the subject in need thereof an effective amount of a mesothelin CAR-expressing cell of the invention that binds to the mesothelin-expressing cell in combination with an effective amount of another therapy.

In one aspect, the invention pertains to a vector comprising a sequence encoding a mesothelin CAR operably linked to promoter for expression in mammalian immune effector cells. In one aspect, the invention provides a recombinant immune effector cell expressing the mesothelin CAR for use in treating mesothelin-expressing tumors. In one aspect, the mesothelin CAR-expressing cell of the invention is capable of contacting a tumor cell with at least one mesothelin CAR of the invention expressed on its surface such that the mesothelin CAR-expressing cell is activated in response to the antigen and the CAR-expressing cell targets the cancer cell and growth of the cancer is inhibited.

In one aspect, the invention pertains to a method of inhibiting growth of a mesothelin-expressing cancer cell, comprising contacting the tumor cell with a-mesothelin CAR-expressing cell such that the CAR-expressing cell is activated in response to the antigen and targets the cancer cell, wherein the growth of the cancer is inhibited. In one aspect, the activated CART targets and kills the cancer cell.

In one aspect, the invention pertains to a method of treating cancer in a subject. The method comprises administering to the subject a mesothelin CAR-expressing cell such that the cancer is treated in the subject. An example of a cancer that is treatable by the mesothelin CAR-expressing cell of the invention is a cancer associated with expression of mesothelin. In one aspect, the cancer associated with expression of mesothelin is selected from mesothelioma, pancreatic cancer, ovarian cancer and lung cancer.

The invention includes a type of cellular therapy where immune effector cells, e.g., T cells or NK cells, are genetically modified to express a chimeric antigen receptor (CAR) and the CAR-expressing cell is infused to a recipient in need thereof. The infused cell is able to kill tumor cells in the recipient. Unlike antibody therapies, CAR-modified immune effector cells are able to replicate in vivo resulting in long-term persistence that can lead to sustained tumor control. In various aspects, the cells administered to the patient, or their progeny, persist in the patient for at least four months, five months, six months, seven months, eight months, nine months, ten months, eleven months, twelve months, thirteen months, fourteen month, fifteen months, sixteen months, seventeen months, eighteen months, nineteen months, twenty months, twenty-one months, twenty-two months, twenty-three months, two years, three years, four years, or five years after administration of the cell to the patient.

The invention also includes a type of cellular therapy where immune effector cells are modified, e.g., by in vitro transcribed RNA, to transiently express a chimeric antigen receptor (CAR) and the CAR-expressing cell is infused to a recipient in need thereof. The infused cell is able to kill cancer cells in the recipient. Thus, in various aspects, the cells administered to the patient, is present for less than one month, e.g., three weeks, two weeks, one week, after administration of the cell to the patient.

Without wishing to be bound by any particular theory, the anti-cancer immunity response elicited by the CAR-modified immune effector cells may be an active or a passive immune response, or alternatively may be due to a direct vs indirect immune response. In one aspect, the CAR transduced T cells exhibit specific proinflammatory cytokine secretion and potent cytolytic activity in response to human cancer cells expressing mesothelin, and mediate bystander killing and mediate regression of an established human tumor. For example, antigen-less tumor cells within a heterogeneous field of mesothelin-expressing tumor may be susceptible to indirect destruction by mesothelin-redirected T cells that has previously reacted against adjacent antigen-positive cancer cells.

In one aspect, the fully-human scFv bearing CAR-modified immune effector cells of the invention may be a type of vaccine for ex vivo immunization and/or in vivo therapy in a mammal. In one aspect, the mammal is a human.

With respect to ex vivo immunization, at least one of the following occurs in vitro prior to administering the cell into a mammal: i) expansion of the cells, ii) introducing a nucleic acid encoding a KIR-CAR to the cells, and/or iii) cryopreservation of the cells.

Ex vivo procedures are well known in the art and are discussed more fully below. Briefly, cells are isolated from a mammal (preferably a human) and genetically modified (i.e., transduced or transfected in vitro) with a vector expressing a KIR-CAR disclosed herein. The KIR-CAR-modified cell can be administered to a mammalian recipient to provide a therapeutic benefit. The mammalian recipient may be a human and the KIR-CAR-modified cell can be autologous with respect to the recipient. Alternatively, the cells can be allogeneic, syngeneic or xenogeneic with respect to the recipient.

The procedure for ex vivo expansion of hematopoietic stem and progenitor cells is described in U.S. Pat. No. 5,199,942, incorporated herein by reference, can be applied to the cells of the present invention. Other suitable methods are known in the art, therefore the present invention is not limited to any particular method of ex vivo expansion of the cells. Briefly, ex vivo culture and expansion of T cells comprises: (1) collecting CD34+ hematopoietic stem and progenitor cells from a mammal from peripheral blood harvest or bone marrow explants; and (2) expanding such cells ex vivo. In addition to the cellular growth factors described in U.S. Pat. No. 5,199,942, other factors such as flt3-L, IL-1, IL-3 and c-kit ligand, can be used for culturing and expansion of the cells.

In addition to using a cell-based vaccine in terms of ex vivo immunization, the present invention also provides compositions and methods for in vivo immunization to elicit an immune response directed against an antigen in a patient.

Generally, the cells activated and expanded as described herein may be utilized in the treatment and prevention of diseases that arise in individuals who are immunocompromised. In particular, the KIR-CAR-modified T cells of the invention are used in the treatment of cancer. In certain embodiments, the cells of the invention are used in the treatment of patients at risk for developing cancer. Thus, the present invention provides methods for the treatment or prevention of cancer comprising administering to a subject in need thereof, a therapeutically effective amount of the KIR-CAR-modified T cells of the invention.

The KIR-CAR-modified T cells of the present invention may be administered either alone, or as a pharmaceutical composition in combination with diluents and/or with other components such as IL-2 or other cytokines or cell populations. Briefly, pharmaceutical compositions of the present invention may comprise a target cell population as described herein, in combination with one or more pharmaceutically or physiologically acceptable carriers, diluents or excipients. Such compositions may comprise buffers such as neutral buffered saline, phosphate buffered saline and the like; carbohydrates such as glucose, mannose, sucrose or dextrans, mannitol; proteins; polypeptides or amino acids such as glycine; antioxidants; chelating agents such as EDTA or glutathione; adjuvants (e.g., aluminum hydroxide); and preservatives. Compositions of the present invention are preferably formulated for intravenous administration.

The present invention also provides methods for inhibiting the proliferation or reducing a mesothelin-expressing cell population, the methods comprising contacting a population of cells comprising a mesothelin-expressing cell with a mesothelin CAR-expressing cell (e.g., a NKR-CAR of the invention that binds to the mesothelin-expressing cell). In a specific aspect, the invention provides methods for inhibiting the proliferation or reducing the population of cancer cells expressing mesothelin, the methods comprising contacting the mesothelin-expressing cancer cell population with a mesothelin CAR-expressing cell of the invention that binds to the mesothelin-expressing cell. In one aspect, the present invention provides methods for inhibiting the proliferation or reducing the population of cancer cells expressing mesothelin, the methods comprising contacting the mesothelin-expressing cancer cell population with a mesothelin CAR-expressing cell of the invention that binds to the mesothelin-expressing cell. In certain aspects, the mesothelin CAR-expressing cell of the invention reduces the quantity, number, amount or percentage of cells and/or cancer cells by at least 25%, at least 30%, at least 40%, at least 50%, at least 65%, at least 75%, at least 85%, at least 95%, or at least 99% in a subject with or animal model for mesothelioma or another cancer associated with mesothelin-expressing cells relative to a negative control. In one aspect, the subject is a human.

The present invention also provides methods for preventing, treating and/or managing a disease associated with mesothelin-expressing cells (e.g., mesothelioma), the methods comprising administering to a subject in need a mesothelin CAR-expressing cell of the invention that binds to the mesothelin-expressing cell. In one aspect, the subject is a human.

The present invention provides methods for preventing relapse of cancer associated with mesothelin-expressing cells, the methods comprising administering to a subject in need thereof a mesothelin CAR-expressing cell of the invention that binds to the mesothelin-expressing cell. In one aspect, the methods comprise administering to the subject in need thereof an effective amount of a mesothelin CAR-expressing cell of the invention that binds to the mesothelin-expressing cell in combination with an effective amount of another therapy.

Combination Therapies

A CAR-expressing cell described herein may be used in combination with other known agents and therapies. Administered "in combination", as used herein, means that two (or more) different treatments are delivered to the subject during the course of the subject's affliction with the disorder, e.g., the two or more treatments are delivered after the subject has been diagnosed with the disorder and before the disorder has been cured or eliminated or treatment has ceased for other reasons. In some embodiments, the delivery of one treatment is still occurring when the delivery of the second begins, so that there is overlap in terms of administration. This is sometimes referred to herein as "simultaneous" or "concurrent delivery". In other embodiments, the delivery of one treatment ends before the delivery of the other treatment begins. In some embodiments of either case, the treatment is more effective because of combined administration. For example, the second treatment is more effective, e.g., an equivalent effect is seen with less of the second treatment, or the second treatment reduces symptoms to a greater extent, than would be seen if the second treatment were administered in the absence of the first treatment, or the analogous situation is seen with the first treatment. In some embodiments, delivery is such that the reduction in a symptom, or other parameter related to the disorder is greater than what would be observed with one treatment delivered in the absence of the other. The effect of the two treatments can be partially additive, wholly additive, or greater than additive. The delivery can be such that an effect of the first treatment delivered is still detectable when the second is delivered.

A CAR-expressing cell described herein and the at least one additional therapeutic agent can be administered simultaneously, in the same or in separate compositions, or sequentially. For sequential administration, the CAR-expressing cell described herein can be administered first, and the additional agent can be administered second, or the order of administration can be reversed.

The CAR therapy and/or other therapeutic agents, procedures or modalities can be administered during periods of active disorder, or during a period of remission or less active disease. The CAR therapy can be administered before the other treatment, concurrently with the treatment, post-treatment, or during remission of the disorder.

When administered in combination, the CAR therapy and the additional agent (e.g., second or third agent), or all, can be administered in an amount or dose that is higher, lower or the same than the amount or dosage of each agent used individually, e.g., as a monotherapy. In certain embodiments, the administered amount or dosage of the CAR therapy, the additional agent (e.g., second or third agent), or all, is lower (e.g., at least 20%, at least 30%, at least 40%, or at least 50%) than the amount or dosage of each agent used individually, e.g., as a monotherapy. In other embodiments, the amount or dosage of the CAR therapy, the additional agent (e.g., second or third agent), or all, that results in a desired effect (e.g., treatment of cancer) is lower (e.g., at least 20%, at least 30%, at least 40%, or at least 50% lower) than the amount or dosage of each agent used individually, e.g., as a monotherapy, required to achieve the same therapeutic effect.

In further aspects, a CAR-expressing cell described herein may be used in a treatment regimen in combination with surgery, cytokines, radiation, or chemotherapy such as cytoxan, fludarabine, histone deacetylase inhibitors, demethylating agents, or peptide vaccine, such as that described in Izumoto et al. 2008 J Neurosurg 108:963-971.

In certain instances, compounds of the present invention are combined with other therapeutic agents, such as other anti-cancer agents, anti-allergic agents, anti-nausea agents (or anti-emetics), pain relievers, cytoprotective agents, and combinations thereof.

In one embodiment, a CAR-expressing cell described herein can be used in combination with a chemotherapeutic agent. Exemplary chemotherapeutic agents include an anthracycline (e.g., doxorubicin (e.g., liposomal doxorubicin)). a vinca alkaloid (e.g., vinblastine, vincristine, vindesine, vinorelbine), an alkylating agent (e.g., cyclophosphamide, decarbazine, melphalan, ifosfamide, temozolomide), an immune cell antibody (e.g., alemtuzamab, gemtuzumab, rituximab, ofatumumab, tositumomab, brentuximab), an antimetabolite (including, e.g., folic acid antagonists, pyrimidine analogs, purine analogs and adenosine deaminase inhibitors (e.g., fludarabine)), an mTOR inhibitor, a TNFR glucocorticoid induced TNFR related protein (GITR) agonist, a proteasome inhibitor (e.g., aclacinomycin A, gliotoxin or bortezomib), an immunomodulator such as thalidomide or a thalidomide derivative (e.g., lenalidomide).

General Chemotherapeutic agents considered for use in combination therapies include anastrozole (Arimidex®), bicalutamide (Casodex®), bleomycin sulfate (Blenoxane®), busulfan (Myleran®), busulfan injection (Busulfex®), capecitabine (Xeloda®), N4-pentoxycarbonyl-5-deoxy-5-fluorocytidine, carboplatin (Paraplatin®), carmustine (BiCNU®), chlorambucil (Leukeran®), cisplatin (Platinol®), cladribine (Leustatin®), cyclophosphamide (Cytoxan® or Neosar®), cytarabine, cytosine arabinoside (Cytosar-U®), cytarabine liposome injection (DepoCyt®), dacarbazine (DTIC-Dome®), dactinomycin (Actinomycin D, Cosmegan), daunorubicin hydrochloride (Cerubidine®), daunorubicin citrate liposome injection (DaunoXome®), dexamethasone, docetaxel (Taxotere®), doxorubicin hydrochloride (Adriamycin®, Rubex®), etoposide (Vepesid®), fludarabine phosphate (Fludara®), 5-fluorouracil (Adrucil®, Efudex®), flutamide (Eulexin®), tezacitibine, Gemcitabine (difluorodeoxycitidine), hydroxyurea (Hydrea®), Idarubicin (Idamycin®), ifosfamide (IFEX®), irinotecan (Camptosar®), L-asparaginase (ELSPAR®), leucovorin calcium, melphalan (Alkeran®), 6-mercaptopurine (Purinethol®), methotrexate (Folex®), mitoxantrone (Novantrone®), mylotarg, paclitaxel (Taxol®), phoenix (Yttrium90/MX-DTPA), pentostatin, polifeprosan 20 with carmustine implant (Gliadel®), tamoxifen citrate (Nolvadex®), teniposide (Vumon®), 6-thioguanine, thiotepa, tirapazamine (Tirazone®), topotecan hydrochloride for injection (Hycamptin®), vinblastine (Velban®), vincristine (Oncovin®), and vinorelbine (Navelbine®).

Anti-cancer agents of particular interest for combinations with the compounds of the present invention include: anthracyclines; alkylating agents; antimetabolites; drugs that inhibit either the calcium dependent phosphatase calcineurin or the p70S6 kinase FK506) or inhibit the p70S6 kinase; mTOR inhibitors; immunomodulators; anthracyclines; vinca alkaloids; proteosome inhibitors; GITR agonists; protein tyrosine phosphatase inhibitors; a CDK4 kinase inhibitor; a BTK inhibitor; a MKN kinase inhibitor; a DGK kinase inhibitor; or an oncolytic virus.

Exemplary antimetabolites include, without limitation, pyrimidine analogs, purine analogs and adenosine deaminase inhibitors): methotrexate (Rheumatrex®, Trexall®), 5-fluorouracil (Adrucil®, Efudex®, Fluoroplex®), floxuridine (FUDF®), cytarabine (Cytosar-U®, Tarabine PFS), 6-mercaptopurine (Puri-Nethol®)), 6-thioguanine (Thioguanine Tabloid®), fludarabine phosphate (Fludara®), pentostatin (Nipent®), pemetrexed (Alimta®), raltitrexed (Tomudex®), cladribine (Leustatin®), clofarabine (Clofarex®, Clolar®), azacitidine (Vidaza®), decitabine and gemcitabine (Gemzar®). Preferred antimetabolites include, cytarabine, clofarabine and fludarabine.

Exemplary alkylating agents include, without limitation, nitrogen mustards, ethylenimine derivatives, alkyl sulfonates, nitrosoureas and triazenes): uracil mustard (Aminouracil Mustard®, Chlorethaminacil®, Demethyldopan®, Desmethyldopan®, Haemanthamine®, Nordopan®, Uracil nitrogen Mustard®, Uracillost®, Uracilmostaza®, Uramustin®, Uramustine®), chlormethine (Mustargen®), cyclophosphamide (Cytoxan®, Neosar®, Clafen®, Endoxan®, Procytox®, Revimmune™), ifosfamide (Mitoxana®), melphalan (Alkeran®), Chlorambucil (Leukeran®), pipobroman (Amedel®, Vercyte®), triethylenemelamine (Hemel®, Hexalen®, Hexastat®), triethylenethiophosphoramine, Temozolomide (Temodar®), thiotepa (Thioplex®), busulfan (Busilvex®, Myleran®), carmustine (BiCNU®), lomustine (CeeNU®), streptozocin (Zanosar®), and Dacarbazine (DTIC-Dome®). Additional exemplary alkylating agents include, without limitation, Oxaliplatin (Eloxatin®); Temozolomide (Temodar® and Temodal®); Dactinomycin (also known as actinomycin-D, Cosmegen®); Melphalan (also known as L-PAM, L-sarcolysin, and phenylalanine mustard, Alkeran®); Altretamine (also known as hexamethylmelamine (HMM), Hexalen®); Carmustine (BiCNU®); Bendamustine (Treanda®); Busulfan (Busulfex® and Myleran®); Carboplatin (Paraplatin®); Lomustine (also known as CCNU, CeeNU®); Cisplatin (also known as CDDP, Platinol® and Platinol®-AQ); Chlorambucil (Leukeran®); Cyclophosphamide (Cytoxan® and Neosar®); Dacarbazine (also known as DTIC, DIC and imidazole carboxamide, DTIC-Dome®); Altretamine (also known as hexamethylmelamine (HMM), Hexalen®); Ifosfamide (Ifex®); Prednumustine; Procarbazine (Matulane®); Mechlorethamine (also known as nitrogen mustard, mustine and mechloroethamine hydrochloride, Mustargen®); Streptozocin (Zanosar®); Thiotepa (also known as thiophosphoamide, TESPA and TSPA, Thioplex®); Cyclophosphamide (Endoxan®, Cytoxan®, Neosar®, Procytox®, Revimmune®); and Bendamustine HCl (Treanda®).

In embodiments, a CAR-expressing cell described herein is administered to a subject in combination with fludarabine, cyclophosphamide, and/or rituximab. In embodiments, a CAR-expressing cell described herein is administered to a subject in combination with fludarabine, cyclophosphamide, and rituximab (FCR). In embodiments, the subject has CLL. For example, the subject has a deletion in the short arm of chromosome 17 (del(17p), e.g., in a leukemic cell). In other examples, the subject does not have a del(17p). In embodiments, the subject comprises a leukemic cell comprising a mutation in the immunoglobulin heavy-chain variable-region ($IgV_H$) gene. In other embodiments, the subject does not comprise a leukemic cell comprising a mutation in the immunoglobulin heavy-chain variable-region ($IgV_H$) gene. In embodiments, the fludarabine is administered at a dosage of about 10-50 mg/m² (e.g., about 10-15, 15-20, 20-25, 25-30, 30-35, 35-40, 40-45, or 45-50 mg/m²), e.g., intravenously. In embodiments, the cyclophosphamide is administered at a dosage of about 200-300 mg/m² (e.g., about 200-225, 225-250, 250-275, or 275-300 mg/m²), e.g., intravenously. In embodiments, the rituximab is administered at a dosage of about 400-600 mg/m2 (e.g., 400-450, 450-500, 500-550, or 550-600 mg/m²), e.g., intravenously.

In embodiments, a CAR-expressing cell described herein is administered to a subject in combination with bendamustine and rituximab. In embodiments, the subject has CLL. For example, the subject has a deletion in the short arm of chromosome 17 (del(17p), e.g., in a leukemic cell). In other examples, the subject does not have a del(17p). In embodiments, the subject comprises a leukemic cell comprising a mutation in the immunoglobulin heavy-chain variable-region ($IgV_H$) gene. In other embodiments, the subject does not comprise a leukemic cell comprising a mutation in the immunoglobulin heavy-chain variable-region ($IgV_H$) gene. In embodiments, the bendamustine is administered at a dosage of about 70-110 mg/m2 (e.g., 70-80, 80-90, 90-100, or 100-110 mg/m2), e.g., intravenously. In embodiments, the rituximab is administered at a dosage of about 400-600 mg/m2 (e.g., 400-450, 450-500, 500-550, or 550-600 mg/m²), e.g., intravenously.

In embodiments, a CAR-expressing cell described herein is administered to a subject in combination with rituximab, cyclophosphamide, doxorubicine, vincristine, and/or a corticosteroid (e.g., prednisone). In embodiments, a CAR-expressing cell described herein is administered to a subject in combination with rituximab, cyclophosphamide, doxorubicine, vincristine, and prednisone (R-CHOP). In embodiments, the subject has diffuse large B-cell lymphoma (DLBCL). In embodiments, the subject has nonbulky limited-stage DLBCL (e.g., comprises a tumor having a size/diameter of less than 7 cm). In embodiments, the subject is treated with radiation in combination with the R-CHOP. For example, the subject is administered R-CHOP (e.g., 1-6 cycles, e.g., 1, 2, 3, 4, 5, or 6 cycles of R-CHOP), followed by radiation. In some cases, the subject is administered R-CHOP (e.g., 1-6 cycles, e.g., 1, 2, 3, 4, 5, or 6 cycles of R-CHOP) following radiation.

In embodiments, a CAR-expressing cell described herein is administered to a subject in combination with etoposide, prednisone, vincristine, cyclophosphamide, doxorubicin, and/or rituximab. In embodiments, a CAR-expressing cell described herein is administered to a subject in combination with etoposide, prednisone, vincristine, cyclophosphamide, doxorubicin, and rituximab (EPOCH-R). In embodiments, a CAR-expressing cell described herein is administered to a subject in combination with dose-adjusted EPOCH-R (DA-EPOCH-R). In embodiments, the subject has a B cell lymphoma, e.g., a Myc-rearranged aggressive B cell lymphoma.

In embodiments, a CAR-expressing cell described herein is administered to a subject in combination with rituximab and/or lenalidomide. Lenalidomide ((RS)-3-(4-Amino-1-oxo 1,3-dihydro-2H-isoindol-2-yl)piperidine-2,6-dione) is an immunomodulator. In embodiments, a CAR-expressing cell described herein is administered to a subject in combination with rituximab and lenalidomide. In embodiments, the subject has follicular lymphoma (FL) or mantle cell lymphoma (MCL). In embodiments, the subject has FL and has not previously been treated with a cancer therapy. In embodiments, lenalidomide is administered at a dosage of about 10-20 mg (e.g., 10-15 or 15-20 mg), e.g., daily. In embodiments, rituximab is administered at a dosage of about 350-550 mg/m² (e.g., 350-375, 375-400, 400-425, 425-450, 450-475, or 475-500 mg/m²), e.g., intravenously.

Exemplary mTOR inhibitors include, e.g., temsirolimus; ridaforolimus (formally known as deferolimus, (1R,2R,4S)-4-[(2R)-2 [(1R,9S,12S,15R,16E,18R,19R,21R,23S,24E, 26E,28Z,30S,32S,35R)-1,18-dihydroxy-19,30-dimethoxy-15,17,21,23,29,35-hexamethyl-2,3,10,14,20-pentaoxo-11, 36-dioxa-4-azatricyclo[30.3.1.0$^{4,9}$] hexatriaconta-16,24,26, 28-tetraen-12-yl]propyl]-2-methoxycyclohexyl dimethylphosphinate, also known as AP23573 and MK8669, and described in PCT Publication No. WO 03/064383); everolimus (Afinitor® or RAD001); rapamycin (AY22989, Sirolimus®); simapimod (CAS 164301-51-3); emsirolimus, (5-{2,4-Bis[(3S)-3-methylmorpholin-4-yl] pyrido[2,3-d]pyrimidin-7-yl}-2-methoxyphenyl)methanol (AZD8055); 2-Amino-8-[trans-4-(2-hydroxyethoxy)cyclohexyl]-6-(6-methoxy-3-pyridinyl)-4-methyl-pyrido[2,3-d] pyrimidin-7(8H)-one (PF04691502, CAS 1013101-36-4); and N²-[1,4-dioxo-4-[[4-(4-oxo-8-phenyl-4H-1-benzopyran-2-yl)morpholinium-4-yl]methoxy]butyl]-L-arginylglycyl-L-α-aspartylL-serine-(SEQ ID NO: 64), inner salt (SF1126, CAS 936487-67-1), and XL765.

Exemplary immunomodulators include, e.g., afutuzumab (available from Roche®); pegfilgrastim (Neulasta®); lenalidomide (CC-5013, Revlimid®); thalidomide (Thalomid®), actimid (CC4047); and IRX-2 (mixture of human cytokines including interleukin 1, interleukin 2, and interferon γ, CAS 951209-71-5, available from IRX Therapeutics).

Exemplary anthracyclines include, e.g., doxorubicin (Adriamycin® and Rubex®); bleomycin (Lenoxane®); daunorubicin (dauorubicin hydrochloride, daunomycin, and rubidomycin hydrochloride, Cerubidine®); daunorubicin liposomal (daunorubicin citrate liposome, DaunoXome®); mitoxantrone (DHAD, Novantrone®); epirubicin (Ellence™); idarubicin (Idamycin®, Idamycin PFS®); mitomycin C (Mutamycin®); geldanamycin; herbimycin; ravidomycin; and desacetylravidomycin.

Exemplary vinca alkaloids include, e.g., vinorelbine tartrate (Navelbine®), Vincristine (Oncovin®), and Vindesine (Eldisine®)); vinblastine (also known as vinblastine sulfate, vincaleukoblastine and VLB, Alkaban-AQ® and Velban®); and vinorelbine (Navelbine®).

Exemplary proteosome inhibitors include bortezomib (Velcade®); carfilzomib (PX-171-007, (S)-4-Methyl-N—((S)-1-(((S)-4-methyl-1-((R)-2-methyloxiran-2-yl)-1-oxopentan-2-yl)amino)-1-oxo-3-phenylpropan-2-yl)-2-((S)-2-(2-morpholinoacetamido)-4-phenylbutanamido)-pentanamide); marizomib (NPI-0052); ixazomib citrate (MLN-9708); delanzomib (CEP-18770); and O-Methyl-N-[(2-methyl-5-thiazolyl)carbonyl]-L-seryl-O-methyl-N-[(1S)-2-[(2R)-2-methyl-2-oxiranyl]-2-oxo-1-(phenylmethyl)ethyl]-L-serinamide (ONX-0912).

In embodiments, a CAR-expressing cell described herein is administered to a subject in combination with brentuximab. Brentuximab is an antibody-drug conjugate of anti-CD30 antibody and monomethyl auristatin E. In embodiments, the subject has Hodgkin's lymphoma (HL), e.g., relapsed or refractory HL. In embodiments, the subject comprises CD30+ HL. In embodiments, the subject has undergone an autologous stem cell transplant (ASCT). In embodiments, the subject has not undergone an ASCT. In embodiments, brentuximab is administered at a dosage of about 1-3 mg/kg (e.g., about 1-1.5, 1.5-2, 2-2.5, or 2.5-3 mg/kg), e.g., intravenously, e.g., every 3 weeks.

In embodiments, a CAR-expressing cell described herein is administered to a subject in combination with brentuximab and dacarbazine or in combination with brentuximab and bendamustine. Dacarbazine is an alkylating agent with a chemical name of 5-(3,3-Dimethyl-1-triazenyl)imidazole-4-carboxamide. Bendamustine is an alkylating agent with a chemical name of 4-[5-[Bis(2-chloroethyl)amino]-1-methylbenzimidazol-2-yl]butanoic acid. In embodiments, the subject has Hodgkin's lymphoma (HL). In embodiments, the subject has not previously been treated with a cancer therapy. In embodiments, the subject is at least 60 years of age, e.g., 60, 65, 70, 75, 80, 85, or older. In embodiments, dacarbazine is administered at a dosage of about 300-450 mg/m$^2$ (e.g., about 300-325, 325-350, 350-375, 375-400, 400-425, or 425-450 mg/m$^2$), e.g., intravenously. In embodiments, bendamustine is administered at a dosage of about 75-125 mg/m2 (e.g., 75-100 or 100-125 mg/m$^2$, e.g., about 90 mg/m$^2$), e.g., intravenously. In embodiments, brentuximab is administered at a dosage of about 1-3 mg/kg (e.g., about 1-1.5, 1.5-2, 2-2.5, or 2.5-3 mg/kg), e.g., intravenously, e.g., every 3 weeks.

In some embodiments, a CAR-expressing cell described herein is administered to a subject in combination with a CD20 inhibitor, e.g., an anti-CD20 antibody (e.g., an anti-CD20 mono- or bispecific antibody) or a fragment thereof. Exemplary anti-CD20 antibodies include but are not limited to rituximab, ofatumumab, ocrelizumab, veltuzumab, obinutuzumab, TRU-015 (Trubion Pharmaceuticals), ocaratuzumab, and Pro131921 (Genentech). See, e.g., Lim et al. Haematologica. 95.1(2010):135-43.

In some embodiments, the anti-CD20 antibody comprises rituximab. Rituximab is a chimeric mouse/human monoclonal antibody IgG1 kappa that binds to CD20 and causes cytolysis of a CD20 expressing cell, e.g., as described in www.accessdata.fda.gov/drugsatfda_docs/label/2010/103705s5311lbl.pdf. In embodiments, a CAR-expressing cell described herein is administered to a subject in combination with rituximab. In embodiments, the subject has CLL or SLL.

In some embodiments, rituximab is administered intravenously, e.g., as an intravenous infusion. For example, each infusion provides about 500-2000 mg (e.g., about 500-550, 550-600, 600-650, 650-700, 700-750, 750-800, 800-850, 850-900, 900-950, 950-1000, 1000-1100, 1100-1200, 1200-1300, 1300-1400, 1400-1500, 1500-1600, 1600-1700, 1700-1800, 1800-1900, or 1900-2000 mg) of rituximab. In some embodiments, rituximab is administered at a dose of 150 mg/m$^2$ to 750 mg/m$^2$, e.g., about 150-175 mg/m$^2$, 175-200 mg/m$^2$, 200-225 mg/m$^2$, 225-250 mg/m$^2$, 250-300 mg/m$^2$, 300-325 mg/m$^2$, 325-350 mg/m$^2$, 350-375 mg/m$^2$, 375-400 mg/m$^2$, 400-425 mg/m$^2$, 425-450 mg/m$^2$, 450-475 mg/m$^2$, 475-500 mg/m$^2$, 500-525 mg/m$^2$, 525-550 mg/m$^2$, 550-575 mg/m$^2$, 575-600 mg/m$^2$, 600-625 mg/m$^2$, 625-650 mg/m$^2$, 650-675 mg/m$^2$, or 675-700 mg/m$^2$, where m$^2$ indicates the body surface area of the subject. In some embodiments, rituximab is administered at a dosing interval of at least 4 days, e.g., 4, 7, 14, 21, 28, 35 days, or more. For example, rituximab is administered at a dosing interval of at least 0.5 weeks, e.g., 0.5, 1, 2, 3, 4, 5, 6, 7, 8 weeks, or more. In some embodiments, rituximab is administered at a dose and dosing interval described herein for a period of time, e.g., at least 2 weeks, e.g., at least 2, 3, 4, 5, 6, 7, 8, 9, 10, 11, 12, 13, 14, 15, 16, 17, 18, 19, 20 weeks, or greater. For example, rituximab is administered at a dose and dosing interval described herein for a total of at least 4 doses per treatment cycle (e.g., at least 4, 5, 6, 7, 8, 9, 10, 11, 12, 13, 14, 15, 16, or more doses per treatment cycle).

In some embodiments, the anti-CD20 antibody comprises ofatumumab. Ofatumumab is an anti-CD20 IgG1κ human monoclonal antibody with a molecular weight of approximately 149 kDa. For example, ofatumumab is generated using transgenic mouse and hybridoma technology and is expressed and purified from a recombinant murine cell line (NS0). See, e.g., www.accessdata.fda.gov/drugsatfda_docs/label/2009/125326lbl.pdf; and Clinical Trial Identifier number NCT01363128, NCT01515176, NCT01626352, and NCT01397591. In embodiments, a CAR-expressing cell described herein is administered to a subject in combination with ofatumumab. In embodiments, the subject has CLL or SLL.

In some embodiments, ofatumumab is administered as an intravenous infusion. For example, each infusion provides about 150-3000 mg (e.g., about 150-200, 200-250, 250-300, 300-350, 350-400, 400-450, 450-500, 500-550, 550-600, 600-650, 650-700, 700-750, 750-800, 800-850, 850-900, 900-950, 950-1000, 1000-1200, 1200-1400, 1400-1600, 1600-1800, 1800-2000, 2000-2200, 2200-2400, 2400-2600, 2600-2800, or 2800-3000 mg) of ofatumumab. In embodiments, ofatumumab is administered at a starting dosage of about 300 mg, followed by 2000 mg, e.g., for about 11 doses, e.g., for 24 weeks. In some embodiments, ofatumumab is administered at a dosing interval of at least 4 days, e.g., 4, 7, 14, 21, 28, 35 days, or more. For example, ofatumumab is administered at a dosing interval of at least 1 week, e.g., 1, 2, 3, 4, 5, 6, 7, 8, 9, 10, 11, 12, 24, 26, 28, 20, 22, 24, 26, 28, 30 weeks, or more. In some embodiments, ofatumumab is administered at a dose and dosing interval described herein for a period of time, e.g., at least 1 week, e.g., 1, 2, 3, 4, 5, 6, 7, 8, 9, 10, 11, 12, 13, 14, 15, 16, 17, 18, 19, 20, 22, 24, 26, 28, 30, 40, 50, 60 weeks or greater, or 1, 2, 3, 4, 5, 6, 7, 8, 9, 10, 11, 12 months or greater, or 1, 2, 3, 4, 5 years or greater. For example, ofatumumab is administered at a dose and dosing interval described herein for a total of at least 2 doses per treatment cycle (e.g., at least 2, 3, 4, 5, 6, 7, 8, 9, 10, 11, 12, 13, 14, 15, 16, 18, 20, or more doses per treatment cycle).

In some cases, the anti-CD20 antibody comprises ocrelizumab. Ocrelizumab is a humanized anti-CD20 monoclonal antibody, e.g., as described in Clinical Trials Identifier Nos. NCT00077870, NCT01412333, NCT00779220, NCT00673920, NCT01194570, and Kappos et al. Lancet. 19.378(2011):1779-87.

In some cases, the anti-CD20 antibody comprises veltuzumab. Veltuzumab is a humanized monoclonal antibody against CD20. See, e.g., Clinical Trial Identifier No. NCT00547066, NCT00546793, NCT01101581, and Goldenberg et al. Leuk Lymphoma. 51(5)(2010):747-55.

In some cases, the anti-CD20 antibody comprises GA101. GA101 (also called obinutuzumab or RO5072759) is a humanized and glyco-engineered anti-CD20 monoclonal antibody. See, e.g., Robak. Curr. Opin. Investig. Drugs. 10.6(2009):588-96; Clinical Trial Identifier Numbers: NCT01995669, NCT01889797, NCT02229422, and NCT01414205; and www.accessdata.fda.gov/drugsatfda_docs/label/2013/125486s000lbl.pdf.

In some cases, the anti-CD20 antibody comprises AME-133v. AME-133v (also called LY2469298 or ocaratuzumab) is a humanized IgG1 monoclonal antibody against CD20 with increased affinity for the FcγRIIIa receptor and an enhanced antibody dependent cellular cytotoxicity (ADCC) activity compared with rituximab. See, e.g., Robak et al. BioDrugs 25.1(2011):13-25; and Forero-Torres et al. Clin Cancer Res. 18.5(2012):1395-403.

In some cases, the anti-CD20 antibody comprises PRO131921. PRO131921 is a humanized anti-CD20 monoclonal antibody engineered to have better binding to FcγRIIIa and enhanced ADCC compared with rituximab. See, e.g., Robak et al. BioDrugs 25.1(2011):13-25; and Casulo et al. Clin Immunol. 154.1(2014):37-46; and Clinical Trial Identifier No. NCT00452127.

In some cases, the anti-CD20 antibody comprises TRU-015. TRU-015 is an anti-CD20 fusion protein derived from domains of an antibody against CD20. TRU-015 is smaller than monoclonal antibodies, but retains Fc-mediated effector functions. See, e.g., Robak et al. BioDrugs 25.1(2011):13-25. TRU-015 contains an anti-CD20 single-chain variable fragment (scFv) linked to human IgG1 hinge, CH2, and CH3 domains but lacks CH1 and CL domains.

In some embodiments, an anti-CD20 antibody described herein is conjugated or otherwise bound to a therapeutic agent, e.g., a chemotherapeutic agent (e.g., cytoxan, fludarabine, histone deacetylase inhibitor, demethylating agent, peptide vaccine, anti-tumor antibiotic, tyrosine kinase inhibitor, alkylating agent, anti-microtubule or anti-mitotic agent), anti-allergic agent, anti-nausea agent (or anti-emetic), pain reliever, or cytoprotective agent described herein.

In embodiments, a CAR-expressing cell described herein is administered to a subject in combination with a B-cell lymphoma 2 (BCL-2) inhibitor (e.g., venetoclax, also called ABT-199 or GDC-0199) and/or rituximab. In embodiments, a CAR-expressing cell described herein is administered to a subject in combination with venetoclax and rituximab. Venetoclax is a small molecule that inhibits the anti-apoptotic protein, BCL-2. The structure of venetoclax (4-(4-{[2-(4-chlorophenyl)-4,4-dimethylcyclohex-1-en-1-yl]methyl}piperazin-1-yl)-N-({3-nitro-4-[(tetrahydro-2H-pyran-4-ylmethyl)amino]phenyl}sulfonyl)-2-(1H-pyrrolo[2,3-b]pyridin-5-yloxy)benzamide) is shown below.

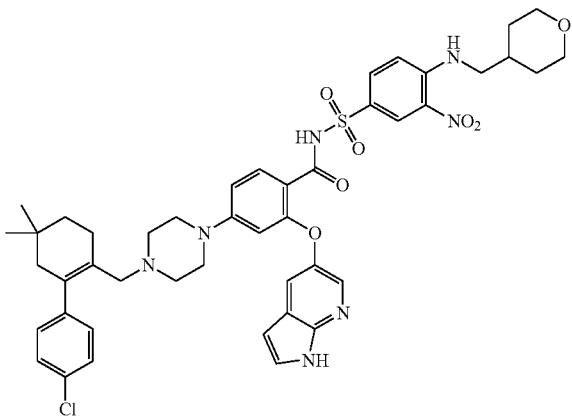 [SMILES: CC1(C)CCC(CN2CCN(c3ccc(C(=O)NS(=O)(=O)c4ccc(NCC5CCOCC5)c([N+](=O)[O-])c4)c(Oc4cnc5[nH]ccc5c4)c3)CC2)=C(c2ccc(Cl)cc2)C1]

In embodiments, the subject has CLL. In embodiments, the subject has relapsed CLL, e.g., the subject has previously been administered a cancer therapy. In embodiments, venetoclax is administered at a dosage of about 15-600 mg (e.g., 15-20, 20-50, 50-75, 75-100, 100-200, 200-300, 300-400, 400-500, or 500-600 mg), e.g., daily. In embodiments, rituximab is administered at a dosage of about 350-550 mg/m2 (e.g., 350-375, 375-400, 400-425, 425-450, 450-475, or 475-500 mg/m2), e.g., intravenously, e.g., monthly.

In some embodiments, a CAR-expressing cell described herein is administered in combination with an oncolytic virus. In embodiments, oncolytic viruses are capable of selectively replicating in and triggering the death of or slowing the growth of a cancer cell. In some cases, oncolytic viruses have no effect or a minimal effect on non-cancer cells. An oncolytic virus includes but is not limited to an oncolytic adenovirus, oncolytic Herpes Simplex Viruses, oncolytic retrovirus, oncolytic parvovirus, oncolytic vaccinia virus, oncolytic Sinbis virus, oncolytic influenza virus, or oncolytic RNA virus (e.g., oncolytic reovirus, oncolytic Newcastle Disease Virus (NDV), oncolytic measles virus, or oncolytic vesicular stomatitis virus (VSV)).

In some embodiments, the oncolytic virus is a virus, e.g., recombinant oncolytic virus, described in US2010/0178684 A1, which is incorporated herein by reference in its entirety. In some embodiments, a recombinant oncolytic virus comprises a nucleic acid sequence (e.g., heterologous nucleic acid sequence) encoding an inhibitor of an immune or inflammatory response, e.g., as described in US2010/0178684 A1, incorporated herein by reference in its entirety. In embodiments, the recombinant oncolytic virus, e.g., oncolytic NDV, comprises a pro-apoptotic protein (e.g., apoptin), a cytokine (e.g., GM-CSF, interferon-gamma, interleukin-2 (IL-2), tumor necrosis factor-alpha), an immunoglobulin (e.g., an antibody against ED-B fibronectin), tumor associated antigen, a bispecific adapter protein (e.g., bispecific antibody or antibody fragment directed against NDV HN protein and a T cell co-stimulatory receptor, such as CD3 or CD28; or fusion protein between human IL-2 and single chain antibody directed against NDV HN protein). See, e.g., Zamarin et al. Future Microbiol. 7.3(2012):347-67, incorporated herein by reference in its entirety. In some embodiments, the oncolytic virus is a chimeric oncolytic NDV described in U.S. Pat. No. 8,591,881 B2, US 2012/0122185 A1, or US 2014/0271677 A1, each of which is incorporated herein by reference in their entireties.

In some embodiments, the oncolytic virus comprises a conditionally replicative adenovirus (CRAd), which is designed to replicate exclusively in cancer cells. See, e.g., Alemany et al. Nature Biotechnol. 18(2000):723-27. In some embodiments, an oncolytic adenovirus comprises one described in Table 1 on page 725 of Alemany et al., incorporated herein by reference in its entirety.

Exemplary oncolytic viruses include but are not limited to the following:

Group B Oncolytic Adenovirus (ColoAd1) (PsiOxus Therapeutics Ltd.) (see, e.g., Clinical Trial Identifier: NCT02053220);

ONCOS-102 (previously called CGTG-102), which is an adenovirus comprising granulocyte-macrophage colony stimulating factor (GM-CSF) (Oncos Therapeutics) (see, e.g., Clinical Trial Identifier: NCT01598129);

VCN-01, which is a genetically modified oncolytic human adenovirus encoding human PH20 hyaluronidase (VCN Biosciences, S.L.) (see, e.g., Clinical Trial Identifiers: NCT02045602 and NCT02045589);

Conditionally Replicative Adenovirus ICOVIR-5, which is a virus derived from wild-type human adenovirus serotype 5 (Had5) that has been modified to selectively replicate in cancer cells with a deregulated retinoblastoma/E2F pathway (Institut Català d'Oncologia) (see, e.g., Clinical Trial Identifier: NCT01864759);

Celyvir, which comprises bone marrow-derived autologous mesenchymal stem cells (MSCs) infected with ICOVIR5, an oncolytic adenovirus (Hospital Infantil Universitario Niño Jesús, Madrid, Spain/Ramon Alemany) (see, e.g., Clinical Trial Identifier: NCT01844661);

CG0070, which is a conditionally replicating oncolytic serotype 5 adenovirus (Ad5) in which human E2F-1 promoter drives expression of the essential E1a viral genes, thereby restricting viral replication and cytotoxicity to Rb pathway-defective tumor cells (Cold Genesys, Inc.) (see, e.g., Clinical Trial Identifier: NCT02143804); or DNX-2401 (formerly named Delta-24-RGD), which is an adenovirus that has been engineered to replicate selectively in retinoblastoma (Rb)-pathway deficient cells and to infect cells that express certain RGD-binding integrins more efficiently (Clinica Universidad de Navarra, Universidad de Navarra/DNAtrix, Inc.) (see, e.g., Clinical Trial Identifier: NCT01956734).

In some embodiments, an oncolytic virus described herein is administering by injection, e.g., subcutaneous, intraarterial, intravenous, intramuscular, intrathecal, or intraperitoneal injection. In embodiments, an oncolytic virus described herein is administered intratumorally, transdermally, transmucosally, orally, intranasally, or via pulmonary administration.

In an embodiment, cells expressing a CAR described herein are administered to a subject in combination with a molecule that decreases the Treg cell population. Methods that decrease the number of (e.g., deplete) Treg cells are known in the art and include, e.g., CD25 depletion, cyclophosphamide administration, modulating GITR function. Without wishing to be bound by theory, it is believed that reducing the number of Treg cells in a subject prior to apheresis or prior to administration of a CAR-expressing cell described herein reduces the number of unwanted immune cells (e.g., Tregs) in the tumor microenvironment and reduces the subject's risk of relapse.

In one embodiment, a CAR expressing cell described herein are administered to a subject in combination with a molecule targeting GITR and/or modulating GITR functions, such as a GITR agonist and/or a GITR antibody that depletes regulatory T cells (Tregs). In embodiments, cells expressing a CAR described herein are administered to a subject in combination with cyclophosphamide. In one embodiment, the GITR binding molecules and/or molecules modulating GITR functions (e.g., GITR agonist and/or Treg depleting GITR antibodies) are administered prior to administration of the CAR-expressing cell. For example, in one embodiment, the GITR agonist can be administered prior to apheresis of the cells. In embodiments, cyclophosphamide is administered to the subject prior to administration (e.g., infusion or re-infusion) of the CAR-expressing cell or prior to aphersis of the cells. In embodiments, cyclophosphamide and an anti-GITR antibody are administered to the subject prior to administration (e.g., infusion or re-infusion) of the CAR-expressing cell or prior to apheresis of the cells. In one embodiment, the subject has cancer (e.g., a solid cancer or a hematological cancer such as ALL or CLL). In an embodiment, the subject has CLL. In embodiments, the subject has ALL. In embodiments, the subject has a solid cancer, e.g., a solid cancer described herein. Exemplary GITR agonists include, e.g., GITR fusion proteins and anti-GITR antibodies (e.g., bivalent anti-GITR antibodies) such as, e.g., a GITR fusion protein described in U.S. Pat. No. 6,111,090, European Patent No.: 090505B1, U.S. Pat. No. 8,586,023, PCT Publication Nos.: WO 2010/003118 and 2011/090754, or an anti-GITR antibody described, e.g., in U.S. Pat. No. 7,025,962, European Patent No.: 1947183B1, U.S. Pat. Nos. 7,812,135, 8,388,967, 8,591,886, European Patent No.: EP 1866339, PCT Publication No.: WO 2011/028683, PCT Publication No.: WO 2013/039954, PCT Publication No.: WO2005/007190, PCT Publication No.: WO 2007/133822, PCT Publication No.: WO2005/055808, PCT Publication No.: WO 99/40196, PCT Publication No.: WO 2001/03720, PCT Publication No.: WO99/20758, PCT Publication No.: WO2006/083289, PCT Publication No.: WO 2005/115451, U.S. Pat. No. 7,618,632, and PCT Publication No.: WO 2011/051726.

In one embodiment, a CAR expressing cell described herein is administered to a subject in combination with a GITR agonist, e.g., a GITR agonist described herein. In one embodiment, the GITR agonist is administered prior to the CAR-expressing cell. For example, in one embodiment, the GITR agonist can be administered prior to apheresis of the cells.

In one embodiment, a CAR expressing cell described herein is administered to a subject in combination with an mTOR inhibitor, e.g., an mTOR inhibitor described herein, e.g., a rapalog such as everolimus. In one embodiment, the mTOR inhibitor is administered prior to the CAR-expressing cell. For example, in one embodiment, the mTOR inhibitor can be administered prior to apheresis of the cells.

In one embodiment, a CAR expressing cell described herein is administered to a subject in combination with a protein tyrosine phosphatase inhibitor, e.g., a protein tyrosine phosphatase inhibitor described herein. In one embodiment, the protein tyrosine phosphatase inhibitor is an SHP-1 inhibitor, e.g., an SHP-1 inhibitor described herein, such as, e.g., sodium stibogluconate. In one embodiment, the protein tyrosine phosphatase inhibitor is an SHP-2 inhibitor.

In one embodiment, a CAR-expressing cell described herein can be used in combination with a kinase inhibitor. In one embodiment, the kinase inhibitor is a CDK4 inhibitor, e.g., a CDK4 inhibitor described herein, e.g., a CD4/6 inhibitor, such as, e.g., 6-Acetyl-8-cyclopentyl-5-methyl-2-(5-piperazin-1-yl-pyridin-2-ylamino)-8H-pyrido[2,3-d]pyrimidin-7-one, hydrochloride (also referred to as palbociclib or PD0332991). In one embodiment, the kinase inhibitor is a BTK inhibitor, e.g., a BTK inhibitor described herein, such as, e.g., ibrutinib. In one embodiment, the kinase inhibitor is an mTOR inhibitor, e.g., an mTOR inhibitor described herein, such as, e.g., rapamycin, a rapamycin analog, OSI-027. The mTOR inhibitor can be, e.g., an mTORC1 inhibitor and/or an mTORC2 inhibitor, e.g., an mTORC1 inhibitor and/or mTORC2 inhibitor described herein. In one embodiment, the kinase inhibitor is a MNK inhibitor, e.g., a MNK inhibitor described herein, such as, e.g., 4-amino-5-(4-fluoroanilino)-pyrazolo [3,4-d]pyrimidine. The MNK inhibitor can be, e.g., a MNK1a, MNK1b, MNK2a and/or MNK2b inhibitor. In one embodiment, the kinase inhibitor is a DGK inhibitor, e.g., a DGK inhibitor described herein, such as, e.g., DGKinh1 (D5919) or DGKinh2 (D5794). In one embodiment, the kinase inhibitor is a CDK4 inhibitor selected from aloisine A; flavopiridol or HMR-1275, 2-(2-chlorophenyl)-5,7-dihydroxy-8-[(3S,4R)-3-hydroxy-1-methyl-4-piperidinyl]-4-chromenone; crizotinib (PF-02341066; 2-(2-Chlorophenyl)-5,7-dihydroxy-8-[(2R,3S)-2-(hydroxymethyl)-1-methyl-3-pyrrolidinyl]-4H-1-benzopyran-4-one, hydrochloride (P276-00); 1-methyl-5-[[2-[5-(trifluoromethyl)-1H-imidazol-2-yl]-4-pyridinyl]oxy]-N-[4-(trifluoromethyl)phenyl]-1H-benzimidazol-2- amine (RAF265); indisulam (E7070); roscovitine (CYC202); palbociclib (PD0332991); dinaciclib (SCH727965); N-[5-[[(5-tert-butyloxazol-2-yl)methyl]thio]thiazol-2-yl]piperidine-4-carboxamide (BMS 387032); 4-[[9-chloro-7-(2,6-difluorophenyl)-5H-pyrimido[5,4-d][2]benzazepin-2-yl]amino]-benzoic acid (MLN8054); 5-[3-(4,6-difluoro-1H-benzimidazol-2-yl)-1H-indazol-5-yl]-N-ethyl-4-methyl-3-pyridinemethanamine (AG-024322); 4-(2,6-dichlorobenzoylamino)-1H-pyrazole-3-carboxylic acid N-(piperidin-4-yl)amide (AT7519); 4-[2-methyl-1-(1-methylethyl)-1H-imidazol-5-yl]-N-[4-(methylsulfonyl)phenyl]-2-pyrimidinamine (AZD5438); and XL281 (BMS908662).

In one embodiment, the kinase inhibitor is a CDK4 inhibitor, e.g., palbociclib (PD0332991), and the palbociclib is administered at a dose of about 50 mg, 60 mg, 70 mg, 75 mg, 80 mg, 90 mg, 100 mg, 105 mg, 110 mg, 115 mg, 120 mg, 125 mg, 130 mg, 135 mg (e.g., 75 mg, 100 mg or 125 mg) daily for a period of time, e.g., daily for 14-21 days of a 28 day cycle, or daily for 7-12 days of a 21 day cycle. In one embodiment, 1, 2, 3, 4, 5, 6, 7, 8, 9, 10, 11, 12 or more cycles of palbociclib are administered.

In embodiments, a CAR-expressing cell described herein is administered to a subject in combination with a cyclin-dependent kinase (CDK) 4 or 6 inhibitor, e.g., a CDK4 inhibitor or a CDK6 inhibitor described herein. In embodiments, a CAR-expressing cell described herein is administered to a subject in combination with a CDK4/6 inhibitor (e.g., an inhibitor that targets both CDK4 and CDK6), e.g., a CDK4/6 inhibitor described herein. In an embodiment, the subject has MCL. MCL is an aggressive cancer that is poorly responsive to currently available therapies, i.e., essentially incurable. In many cases of MCL, cyclin D1 (a regulator of CDK4/6) is expressed (e.g., due to chromosomal translocation involving immunoglobulin and Cyclin D1 genes) in MCL cells. Thus, without being bound by theory, it is thought that MCL cells are highly sensitive to CDK4/6 inhibition with high specificity (i.e., minimal effect on normal immune cells). CDK4/6 inhibitors alone have had some efficacy in treating MCL, but have only achieved partial remission with a high relapse rate. An exemplary CDK4/6 inhibitor is LEE011 (also called ribociclib), the structure of which is shown below.

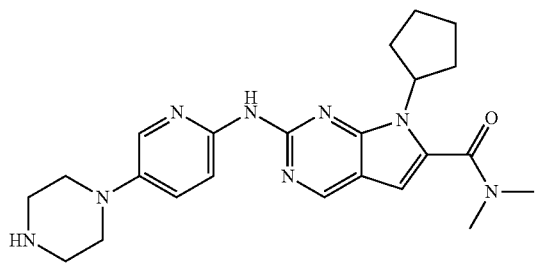 [SMILES: CN(C)C(=O)c1cc2cnc(Nc3ccc(N4CCNCC4)cn3)nc2n1C1CCCC1]

Without being bound by theory, it is believed that administration of a CAR-expressing cell described herein with a CDK4/6 inhibitor (e.g., LEE011 or other CDK4/6 inhibitor described herein) can achieve higher responsiveness, e.g., with higher remission rates and/or lower relapse rates, e.g., compared to a CDK4/6 inhibitor alone.

In one embodiment, the kinase inhibitor is a BTK inhibitor selected from ibrutinib (PCI-32765); GDC-0834; RN-486; CGI-560; CGI-1764; HM-71224; CC-292; ONO-4059; CNX-774; and LFM-A13. In a preferred embodiment, the BTK inhibitor does not reduce or inhibit the kinase activity of interleukin-2-inducible kinase (ITK), and is selected from GDC-0834; RN-486; CGI-560; CGI-1764; HM-71224; CC-292; ONO-4059; CNX-774; and LFM-A13.

In one embodiment, the kinase inhibitor is a BTK inhibitor, e.g., ibrutinib (PCI-32765). In embodiments, a CAR-expressing cell described herein is administered to a subject in combination with a BTK inhibitor (e.g., ibrutinib). In embodiments, a CAR-expressing cell described herein is administered to a subject in combination with ibrutinib (also called PCI-32765). The structure of ibrutinib (1-[(3R)-3-[4-Amino-3-(4-phenoxyphenyl)-1H-pyrazolo[3,4-d]pyrimidin-1-yl]piperidin-1-yl]prop-2-en-1-one) is shown below.

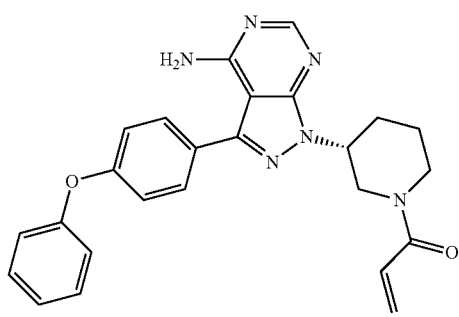 [SMILES: C=CC(=O)N1CCC[C@@H](n2nc(-c3ccc(Oc4ccccc4)cc3)c3c(N)ncnc32)C1]

In embodiments, the subject has CLL, mantle cell lymphoma (MCL), or small lymphocytic lymphoma (SLL). For example, the subject has a deletion in the short arm of chromosome 17 (del(17p), e.g., in a leukemic cell). In other examples, the subject does not have a del(17p). In embodiments, the subject has relapsed CLL or SLL, e.g., the subject has previously been administered a cancer therapy (e.g., previously been administered one, two, three, or four prior cancer therapies). In embodiments, the subject has refractory CLL or SLL. In other embodiments, the subject has follicular lymphoma, e.g., relapse or refractory follicular lymphoma. In some embodiments, ibrutinib is administered at a dosage of about 300-600 mg/day (e.g., about 300-350, 350-400, 400-450, 450-500, 500-550, or 550-600 mg/day, e.g., about 420 mg/day or about 560 mg/day), e.g., orally. In embodiments, the ibrutinib is administered at a dose of about 250 mg, 300 mg, 350 mg, 400 mg, 420 mg, 440 mg, 460 mg, 480 mg, 500 mg, 520 mg, 540 mg, 560 mg, 580 mg, 600 mg (e.g., 250 mg, 420 mg or 560 mg) daily for a period of time, e.g., daily for 21 day cycle, or daily for 28 day cycle. In one embodiment, 1, 2, 3, 4, 5, 6, 7, 8, 9, 10, 11, 12 or more cycles of ibrutinib are administered. In some embodiments, ibrutinib is administered in combination with rituximab. See, e.g., Burger et al. (2013) Ibrutinib In Combination With Rituximab (iR) Is Well Tolerated and Induces a High Rate Of Durable Remissions In Patients With High-Risk Chronic Lymphocytic Leukemia (CLL): New, Updated Results Of a Phase II Trial In 40 Patients, Abstract 675 presented at 55[th] ASH Annual Meeting and Exposition, New Orleans, La. 7-10 December. Without being bound by theory, it is thought that the addition of ibrutinib enhances the T cell proliferative response and may shift T cells from a T-helper-2 (Th2) to T-helper-1 (Th1) phenotype. Th1 and Th2 are phenotypes of helper T cells, with Th1 versus Th2 directing different immune response pathways. A Th1 phenotype is associated with proinflammatory responses, e.g., for killing cells, such as intracellular pathogens/viruses or cancerous cells, or perpetuating autoimmune responses. A Th2 phenotype is associated with eosinophil accumulation and anti-inflammatory responses.

In some embodiments of the methods, uses, and compositions herein, the BTK inhibitor is a BTK inhibitor described in International Application WO/2015/079417, which is herein incorporated by reference in its entirety. For instance, in some embodiments, the BTK inhibitor is a compound of formula (I) or a pharmaceutically acceptable salt thereof;

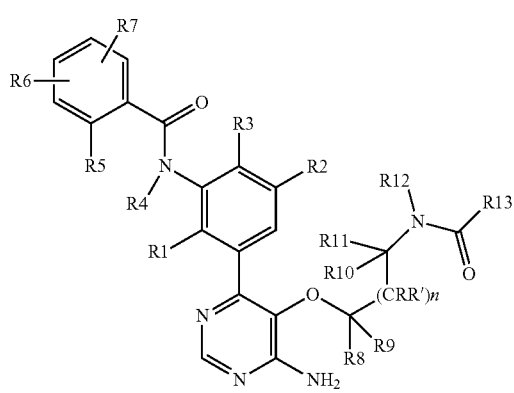

wherein,

R1 is hydrogen, C1-C6 alkyl optionally substituted by hydroxy;

R2 is hydrogen or halogen;

R3 is hydrogen or halogen;

R4 is hydrogen;

R5 is hydrogen or halogen;

or R4 and R5 are attached to each other and stand for a bond, —CH2-, —CH2-CH2-, —CH═CH—, —CH═CH—CH2-; —CH2-CH═CH—; or —CH2-CH2-CH2-;

R6 and R7 stand independently from each other for H, C1-C6 alkyl optionally substituted by hydroxyl, C3-C6 cycloalkyl optionally substituted by halogen or hydroxy, or halogen;

R8, R9, R, R', R10 and R11 independently from each other stand for H, or C1-C6 alkyl optionally substituted by C1-C6 alkoxy; or any two of R8, R9, R, R', R10 and R11 together with the carbon atom to which they are bound may form a 3-6 membered saturated carbocyclic ring;

R12 is hydrogen or C1-C6 alkyl optionally substituted by halogen or C1-C6 alkoxy;

or R12 and any one of R8, R9, R, R', R10 or R11 together with the atoms to which they are bound may form a 4, 5, 6 or 7 membered azacyclic ring, which ring may optionally be substituted by halogen, cyano, hydroxyl, C1-C6 alkyl or C1-C6 alkoxy;

n is 0 or 1; and

R13 is C2-C6 alkenyl optionally substituted by C1-C6 alkyl, C1-C6 alkoxy or N,N-di-C1-C6 alkyl amino; C2-C6 alkynyl optionally substituted by C1-C6 alkyl or C1-C6 alkoxy; or C2-C6 alkylenyl oxide optionally substituted by C1-C6 alkyl.

In some embodiments, the BTK inhibitor of Formula I is chosen from: N-(3-(5-((1-Acryloylazetidin-3-yl)oxy)-6-aminopyrimidin-4-yl)-5-fluoro-2-methylphenyl)-4-cyclopropyl-2-fluorobenzamide; (E)-N-(3-(6-Amino-5-((1-(but-2-enoyl)azetidin-3-yl)oxy)pyrimidin-4-yl)-5-fluoro-2-methylphenyl)-4-cyclopropyl-2-fluorobenzamide; N-(3-(6-Amino-5-((1-propioloylazetidin-3-yl)oxy)pyrimidin-4-yl)-5-fluoro-2-methylphenyl)-4-cyclopropyl-2-fluorobenzamide; N-(3-(6-Amino-5-((1-(but-2-ynoyl)azetidin-3-yl)oxy)pyrimidin-4-yl)-5-fluoro-2-methylphenyl)-4-cyclopropyl-2-fluorobenzamide; N-(3-(5-((1-Acryloylpiperidin-4-yl)oxy)-6-aminopyrimidin-4-yl)-5-fluoro-2-methylphenyl)-4-cyclopropyl-2-fluorobenzamide; N-(3-(6-Amino-5-(2-(N-methylacrylamido)ethoxy)pyrimidin-4-yl)-5-fluoro-2-methylphenyl)-4-cyclopropyl-2-fluorobenzamide; (E)-N-(3-(6-Amino-5-(2-(N-methylbut-2-enamido)ethoxy)pyrimidin-4-yl)-5-fluoro-2-methylphenyl)-4-cyclopropyl-2-fluorobenzamide; N-(3-(6-Amino-5-(2-(N-methylpropiolamido)ethoxy)pyrimidin-4-yl)-5-fluoro-2-methylphenyl)-4-cyclopropyl-2-fluorobenzamide; (E)-N-(3-(6-Amino-5-(2-(4-methoxy-N-methylbut-2-enamido)ethoxy)pyrimidin-4-yl)-5-fluoro-2-methylphenyl)-4-cyclopropyl-2-fluorobenzamide; N-(3-(6-Amino-5-(2-(N-methylbut-2-ynamido)ethoxy)pyrimidin-4-yl)-5-fluoro-2-methylphenyl)-4-cyclopropyl-2-fluorobenzamide; N-(2-((4-Amino-6-(3-(4-cyclopropyl-2-fluorobenzamido)-5-fluoro-2-methylphenyl)pyrimidin-5-yl)oxy)ethyl)-N-methyloxirane-2-carboxamide; N-(2-((4-Amino-6-(3-(6-cyclopropyl-8-fluoro-1-oxoisoquinolin-2(1H)-yl)phenyl) pyrimidin-5-yl)oxy)ethyl)-N-methylacrylamide; N-(3-(5-(2-Acrylamidoethoxy)-6-aminopyrimidin-4-yl)-5-fluoro-2-methylphenyl)-4-cyclopropyl-2-fluorobenzamide; N-(3-(6-Amino-5-(2-(N-ethylacrylamido)ethoxy)pyrimidin-4-yl)-5-fluoro-2-methylphenyl)-4-cyclopropyl-2-fluorobenzamide; N-(3-(6-Amino-5-(2-(N-(2-fluoroethyl)acrylamido)ethoxy) pyrimidin-4-yl)-5-fluoro-2-methylphenyl)-4-cyclopropyl-2-fluorobenzamide; N-(3-(5-(((1-Acrylamidocyclopropyl) methoxy)-6-aminopyrimidin-4-yl)-5-fluoro-2-methylphenyl)-4-cyclopropyl-2-fluorobenzamide; (S)—N-(3-(5-(2-Acrylamidopropoxy)-6-aminopyrimidin-4-yl)-5-fluoro-2-methylphenyl)-4-cyclopropyl-2-fluorobenzamide; (S)—N-(3-(6-Amino-5-(2-(but-2-ynamido)propoxy)pyrimidin-4-yl)-5-fluoro-2-methylphenyl)-4-cyclopropyl-2-fluorobenzamide; (S)—N-(3-(6-Amino-5-(2-(N-methylacrylamido)propoxy)pyrimidin-4-yl)-5-fluoro-2-methylphenyl)-4-cyclopropyl-2-fluorobenzamide; (S)—N-(3-(6-Amino-5-(2-(N-methylbut-2-ynamido)propoxy)pyrimidin-4-yl)-5-fluoro-2-methylphenyl)-4-cyclopropyl-2-fluorobenzamide; N-(3-(6-Amino-5-(3-(N-methylacrylamido)propoxy)pyrimidin-4-yl)-5-fluoro-2-methylphenyl)-4-cyclopropyl-2-fluorobenzamide; (S)—N-(3-(5-((1-Acryloylpyrrolidin-2-yl)methoxy)-6-aminopyrimidin-4-yl)-5-fluoro-2-methylphenyl)-4-cyclopropyl-2-fluorobenzamide; (S)—N-(3-(6-Amino-5-((1-(but-2-ynoyl)pyrrolidin-2-yl)methoxy) pyrimidin-4-yl)-5-fluoro-2-methylphenyl)-4-cyclopropyl-2-fluorobenzamide; (S)-2-(3-(5-((1-Acryloylpyrrolidin-2-yl) methoxy)-6-aminopyrimidin-4-yl)-5-fluoro-2-(hydroxymethyl)phenyl)-6-cyclopropyl-3,4-dihydroisoquinolin-1(2H)-one; N-(2-((4-Amino-6-(3-(6-cyclopropyl-1-oxo-3,4-dihydroisoquinolin-2(1H)-yl)-5-fluoro-2-(hydroxymethyl)phenyl)pyrimidin-5-yl)oxy) ethyl)-N-methylacrylamide; N-(3-(5-(((2S,4R)-1-Acryloyl-4-methoxypyrrolidin-2-yl)methoxy)-6-aminopyrimidin-4-yl)-5-fluoro-2-methylphenyl)-4-cyclopropyl-2-fluorobenzamide; N-(3-(6-Amino-5-(((2S,4R)-1-(but-2-ynoyl)-4-methoxypyrrolidin-2-yl)methoxy)pyrimidin-4-yl)-5-fluoro-2-methylphenyl)-4-cyclopropyl-2-fluorobenzamide; 2-(3-(5-(((2S,4R)-1-Acryloyl-4-methoxypyrrolidin-2-yl)methoxy)-6-aminopyrimidin-4-yl)-5-fluoro-2-(hydroxymethyl)phenyl)-6-cyclopropyl-3,4-dihydroisoquinolin-1(2H)-one; N-(3-(5-(((2S,4S)-1-Acryloyl-4-methoxypyrrolidin-2-yl)methoxy)-6- aminopyrimidin-4-yl)-5-fluoro-2-methylphenyl)-4-cyclopropyl-2-fluorobenzamide; N-(3-(6-Amino-5-(((2S,4S)-1-(but-2-ynoyl)-4-methoxypyrrolidin-2-yl)methoxy)pyrimidin-4-yl)-5-fluoro-2-methylphenyl)-4-cyclopropyl-2-fluorobenzamide; N-(3-(5-(((2S,4R)-1-Acryloyl-4-fluoropyrrolidin-2-yl)methoxy)-6-aminopyrimidin-4-yl)-5-fluoro-2-methylphenyl)-4-cyclopropyl-2-fluorobenzamide; N-(3-(6-Amino-5-(((2S,4R)-1-(but-2-ynoyl)-4-fluoropyrrolidin-2-yl)methoxy)pyrimidin-4-yl)-5-fluoro-2-methylphenyl)-4-cyclopropyl-2-fluorobenzamide; (S)—N-(3-(5-((1-Acryloylazetidin-2-yl)methoxy)-6-aminopyrimidin-4-yl)-5-fluoro-2-methylphenyl)-4-cyclopropyl-2-fluorobenzamide; (S)—N-(3-(6-Amino-5-((1-propioloylazetidin-2-yl)methoxy)pyrimidin-4-yl)-5-fluoro-2-methylphenyl)-4-cyclopropyl-2-fluorobenzamide; (S)-2-(3-(5-((1-Acryloylazetidin-2-yl)methoxy)-6-aminopyrimidin-4-yl)-5-fluoro-2-(hydroxymethyl)phenyl)-6-cyclopropyl-3,4-dihydroisoquinolin-1 (2H)-one; (R)—N-(3-(5-((1-Acryloylazetidin-2-yl)methoxy)-6-aminopyrimidin-4-yl)-5-fluoro-2-methylphenyl)-4-cyclopropyl-2-fluorobenzamide; (R)—N-(3-(5-((1-Acryloylpiperidin-3-yl)methoxy)-6-aminopyrimidin-4-yl)-5-fluoro-2-methylphenyl)-4-cyclopropyl-2-fluorobenzamide; N-(3-(5-(((2R,3S)-1-Acryloyl-3-methoxypyrrolidin-2-yl)methoxy)-6-aminopyrimidin-4-yl)-5-fluoro-2-methylphenyl)-4-cyclopropyl-2-fluorobenzamide; N-(3-(5-(((2S,4R)-1-Acryloyl-4-cyanopyrrolidin-2-yl)methoxy)-6-aminopyrimidin-4-yl)-5-fluoro-2-methylphenyl)-4-cyclopropyl-2-fluorobenzamide; or N-(3-(5-(((2S,4S)-1-Acryloyl-4-cyanopyrrolidin-2-yl)methoxy)-6-aminopyrimidin-4-yl)-5-fluoro-2-methylphenyl)-4-cyclopropyl-2-fluorobenzamide.

Unless otherwise provided, the chemical terms used above in describing the BTK inhibitor of Formula I are used according to their meanings as set out in International Application WO/2015/079417, which is herein incorporated by reference in its entirety.

In one embodiment, the kinase inhibitor is an mTOR inhibitor selected from temsirolimus; ridaforolimus (1R,2R,4S)-4-[(2R)-2 [(1R,9S,12S,15R,16E,18R,19R,21R,23S,24E,26E,28Z,30S,32S,35R)-1,18-dihydroxy-19,30-dimethoxy-15,17,21,23,29,35-hexamethyl-2,3,10,14,20-pentaoxo-11,36-dioxa-4-azatricyclo[30.3.1.0$^{4,9}$] hexatriaconta-16,24,26,28-tetraen-12-yl]propyl]-2-methoxycyclohexyl dimethylphosphinate, also known as AP23573 and MK8669; everolimus (RAD001); rapamycin (AY22989); simapimod; (5-{2,4-bis[(3S)-3-methylmorpholin-4-yl]pyrido[2,3-d]pyrimidin-7-yl}-2-methoxyphenyl) methanol (AZD8055); 2-mmino-8-[trans-4-(2-hydroxyethoxy)cyclohexyl]-6-(6-methoxy-3-pyridinyl)-4-methylpyrido[2,3-d]pyrimidin-7(8H)-one (PF04691502); and N$^2$-[1,4-dioxo-4-[[4-(4-oxo-8-phenyl-4H-1-benzopyran-2-yl)morpholinium-4-yl]methoxy]butyl]-L-arginylglycyl-L-α-aspartylL-serine- (SEQ ID NO: 64), inner salt (SF1126); and XL765.

In one embodiment, the kinase inhibitor is an mTOR inhibitor, e.g., rapamycin, and the rapamycin is administered at a dose of about 3 mg, 4 mg, 5 mg, 6 mg, 7 mg, 8 mg, 9 mg, 10 mg (e.g., 6 mg) daily for a period of time, e.g., daily for 21 day cycle, or daily for 28 day cycle. In one embodiment, 1, 2, 3, 4, 5, 6, 7, 8, 9, 10, 11, 12 or more cycles of rapamycin are administered. In one embodiment, the kinase inhibitor is an mTOR inhibitor, e.g., everolimus and the everolimus is administered at a dose of about 2 mg, 2.5 mg, 3 mg, 4 mg, 5 mg, 6 mg, 7 mg, 8 mg, 9 mg, 10 mg, 11 mg, 12 mg, 13 mg, 14 mg, 15 mg (e.g., 10 mg) daily for a period of time, e.g., daily for 28 day cycle. In one embodiment, 1, 2, 3, 4, 5, 6, 7, 8, 9, 10, 11, 12 or more cycles of everolimus are administered.

In one embodiment, the kinase inhibitor is an MNK inhibitor selected from CGP052088; 4-amino-3-(p-fluorophenylamino)-pyrazolo [3,4-d] pyrimidine (CGP57380); cercosporamide; ETC-1780445-2; and 4-amino-5-(4-fluoroanilino)-pyrazolo [3,4-d] pyrimidine.

In embodiments, a CAR-expressing cell described herein is administered to a subject in combination with a phosphoinositide 3-kinase (PI3K) inhibitor (e.g., a PI3K inhibitor described herein, e.g., idelalisib or duvelisib) and/or rituximab. In embodiments, a CAR-expressing cell described herein is administered to a subject in combination with idelalisib and rituximab. In embodiments, a CAR-expressing cell described herein is administered to a subject in combination with duvelisib and rituximab. Idelalisib (also called GS-1101 or CAL-101; Gilead) is a small molecule that blocks the delta isoform of PI3K. The structure of idelalisib (5-Fluoro-3-phenyl-2-[(1S)-1-(7H-purin-6-ylamino)propyl]-4(3H)-quinazolinone) is shown below.

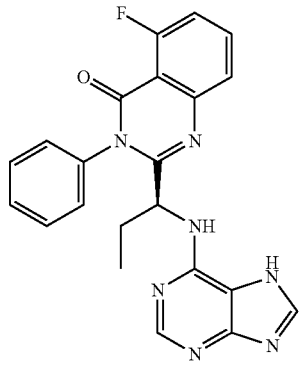 [SMILES: CC[C@H](Nc1ncnc2nc[nH]c12)c1nc2cccc(F)c2c(=O)n1-c1ccccc1]

Duvelisib (also called IPI-145; Infinity Pharmaceuticals and Abbvie) is a small molecule that blocks PI3K-δ,γ. The structure of duvelisib (8-Chloro-2-phenyl-3-[(1S)-1-(9H-purin-6-ylamino)ethyl]-1(2H)-isoquinolinone) is shown below.

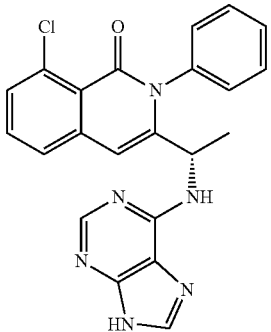 [SMILES: C[C@H](Nc1ncnc2[nH]cnc12)c1cc2cccc(Cl)c2c(=O)n1-c1ccccc1]

In embodiments, the subject has CLL. In embodiments, the subject has relapsed CLL, e.g., the subject has previously been administered a cancer therapy (e.g., previously been administered an anti-CD20 antibody or previously been administered ibrutinib). For example, the subject has a deletion in the short arm of chromosome 17 (del(17p), e.g., in a leukemic cell). In other examples, the subject does not have a del(17p). In embodiments, the subject comprises a leukemic cell comprising a mutation in the immunoglobulin heavy-chain variable-region (IgV$_H$) gene. In other embodiments, the subject does not comprise a leukemic cell comprising a mutation in the immunoglobulin heavy-chain variable-region (IgV$_H$) gene. In embodiments, the subject has a deletion in the long arm of chromosome 11 (del(11q)). In other embodiments, the subject does not have a del(11q). In embodiments, idelalisib is administered at a dosage of about 100-400 mg (e.g., 100-125, 125-150, 150-175, 175-200, 200-225, 225-250, 250-275, 275-300, 325-350, 350-375, or 375-400 mg), e.g., BID. In embodiments, duvelisib is administered at a dosage of about 15-100 mg (e.g., about 15-25, 25-50, 50-75, or 75-100 mg), e.g., twice a day. In embodiments, rituximab is administered at a dosage of about 350-550 mg/m$^2$ (e.g., 350-375, 375-400, 400-425, 425-450, 450-475, or 475-500 mg/m$^2$), e.g., intravenously.

In one embodiment, the kinase inhibitor is a dual phosphatidylinositol 3-kinase (PI3K) and mTOR inhibitor selected from 2-Amino-8-[trans-4-(2-hydroxyethoxy)cyclohexyl]-6-(6-methoxy-3-pyridinyl)-4-methyl-pyrido[2,3-d]pyrimidin-7(8H)-one (PF-04691502); N-[4-[[4-(Dimethylamino)-1-piperidinyl]carbonyl]phenyl]-N'-[4-(4,6-di-4-morpholinyl-1,3,5-triazin-2-yl)phenyl]urea (PF-05212384, PKI-587); 2-Methyl-2-{4-[3-methyl-2-oxo-8-(quinolin-3-yl)-2,3-dihydro-1H-imidazo[4,5-c]quinolin-1-yl]phenyl}propanenitrile (BEZ-235); apitolisib (GDC-0980, RG7422); 2,4-Difluoro-N-{2-(methyloxy)-5-[4-(4-pyridazinyl)-6-quinolinyl]-3-pyridinyl}benzenesulfonamide (GSK2126458); 8-(6-methoxypyridin-3-yl)-3-methyl-1-(4-(piperazin-1-yl)-3-(trifluoromethyl)phenyl)-1H-imidazo[4,5-c]quinolin-2(3H)-one Maleic acid (NVP-BGT226); 3-[4-(4-Morpholinylpyrido[3',2':4,5]furo[3,2-d]pyrimidin-2-yl]phenol (PI-103); 5-(9-isopropyl-8-methyl-2-morpholino-9H-purin-6-yl)pyrimidin-2-amine (VS-5584, SB2343); and N-[2-[(3,5-Dimethoxyphenyl)amino]quinoxalin-3-yl]-4-[(4-methyl-3-methoxyphenyl)carbonyl]aminophenylsulfonamide (XL765).

In embodiments, a CAR-expressing cell described herein is administered to a subject in combination with an anaplastic lymphoma kinase (ALK) inhibitor. Exemplary ALK kinases include but are not limited to crizotinib (Pfizer), ceritinib (Novartis), alectinib (Chugai), brigatinib (also called AP26113; Ariad), entrectinib (Ignyta), PF-06463922 (Pfizer), TSR-011 (Tesaro) (see, e.g., Clinical Trial Identifier No. NCT02048488), CEP-37440 (Teva), and X-396 (Xcovery). In some embodiments, the subject has a solid cancer, e.g., a solid cancer described herein, e.g., lung cancer.

The chemical name of crizotinib is 3-[(1R)-1-(2,6-dichloro-3-fluorophenyl)ethoxy]-5-(1-piperidin-4-ylpyrazol-4-yl)pyridin-2-amine. The chemical name of ceritinib is 5-Chloro-N$^2$-[2-isopropoxy-5-methyl-4-(4-piperidinyl)phenyl]-N$^4$-[2-(isopropylsulfonyl)phenyl]-2,4-pyrimidinediamine. The chemical name of alectinib is 9-ethyl-6,6-dimethyl-8-(4-morpholinopiperidin-1-yl)-11-oxo-6,11-dihydro-5H-benzo[b]carbazole-3-carbonitrile. The chemical name of brigatinib is 5-Chloro-N$^2$-{4-[4-(dimethylamino)-1-piperidinyl]-2-methoxyphenyl}-N$^4$-[2-(dimethylphosphoryl)phenyl]-2,4-pyrimidinediamine. The chemical name of entrectinib is N-(5-(3,5-difluorobenzyl)-1H-indazol-3-yl)-4-(4-methylpiperazin-1-yl)-2-((tetrahydro-2H-pyran-4-yl)amino)benzamide. The chemical name of PF-06463922 is (10R)-7-Amino-12-fluoro-2,10,16-trimethyl-15-oxo-10,15,16,17-tetrahydro-2H-8,4-(metheno)pyrazolo[4,3-h][2,5,11]-benzoxadiazacyclotetradecine-3-carbonitrile. The chemical structure of CEP-37440 is (S)-2-((5-chloro-2-((6-(4-(2-hydroxyethyl)piperazin-1-yl)-1-methoxy-6,7,8,9-tetrahydro-5H-benzo[7]annulen-2-yl)amino)pyrimidin-4-yl)amino)-N-methylbenzamide. The chemical name of X-396 is (R)-6-amino-5-(1-(2,6-dichloro-3-fluorophenyl)ethoxy)-N-(4-(4-methylpiperazine-1-carbonyl)phenyl)pyridazine-3-carboxamide.

Drugs that inhibit either the calcium dependent phosphatase calcineurin (cyclosporine and FK506) or inhibit the p70S6 kinase that is important for growth factor induced signaling (rapamycin). (Liu et al., Cell 66:807-815, 1991; Henderson et al., Immun. 73:316-321, 1991; Bierer et al., Curr. Opin. Immun. 5:763-773, 1993) can also be used. In a further aspect, the cell compositions of the present invention may be administered to a patient in conjunction with (e.g., before, simultaneously or following) bone marrow transplantation, T cell ablative therapy using chemotherapy agents such as, fludarabine, external-beam radiation therapy (XRT), cyclophosphamide, and/or antibodies such as OKT3 or CAMPATH. In one aspect, the cell compositions of the present invention are administered following B-cell ablative therapy such as agents that react with CD20, e.g., Rituxan. For example, in one embodiment, subjects may undergo standard treatment with high dose chemotherapy followed by peripheral blood stem cell transplantation. In certain embodiments, following the transplant, subjects receive an infusion of the expanded immune cells of the present invention. In an additional embodiment, expanded cells are administered before or following surgery.

In embodiments, a CAR-expressing cell described herein is administered to a subject in combination with an indoleamine 2,3-dioxygenase (IDO) inhibitor. IDO is an enzyme that catalyzes the degradation of the amino acid, L-tryptophan, to kynurenine. Many cancers overexpress IDO, e.g., prostatic, colorectal, pancreatic, cervical, gastric, ovarian, head, and lung cancer. pDCs, macrophages, and dendritic cells (DCs) can express IDO. Without being bound by theory, it is thought that a decrease in L-tryptophan (e.g., catalyzed by IDO) results in an immunosuppressive milieu by inducing T-cell anergy and apoptosis. Thus, without being bound by theory, it is thought that an IDO inhibitor can enhance the efficacy of a CAR-expressing cell described herein, e.g., by decreasing the suppression or death of a CAR-expressing immune cell. In embodiments, the subject has a solid tumor, e.g., a solid tumor described herein, e.g., prostatic, colorectal, pancreatic, cervical, gastric, ovarian, head, or lung cancer. Exemplary inhibitors of IDO include but are not limited to 1-methyl-tryptophan, indoximod (NewLink Genetics) (see, e.g., Clinical Trial Identifier Nos. NCT01191216; NCT01792050), and INCB024360 (Incyte Corp.) (see, e.g., Clinical Trial Identifier Nos. NCT01604889; NCT01685255)

In embodiments, a CAR-expressing cell described herein is administered to a subject in combination with a modulator of myeloid-derived suppressor cells (MDSCs). MDSCs accumulate in the periphery and at the tumor site of many solid tumors. These cells suppress T cell responses, thereby hindering the efficacy of CAR-expressing cell therapy. Without being bound by theory, it is thought that administration of a MDSC modulator enhances the efficacy of a CAR-expressing cell described herein. In an embodiment, the subject has a solid tumor, e.g., a solid tumor described herein, e.g., glioblastoma. Exemplary modulators of MDSCs include but are not limited to MCS110 and BLZ945. MCS110 is a monoclonal antibody (mAb) against macrophage colony-stimulating factor (M-CSF). See, e.g., Clinical Trial Identifier No. NCT00757757. BLZ945 is a small molecule inhibitor of colony stimulating factor 1 receptor (CSF1R). See, e.g., Pyonteck et al. Nat. Med. 19(2013): 1264-72. The structure of BLZ945 is shown below.

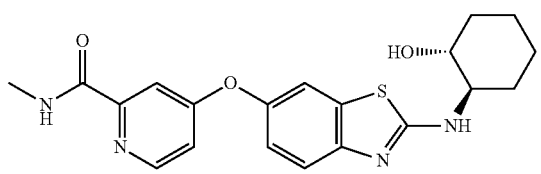 [SMILES: CNC(=O)c1cc(Oc2ccc3nc(N[C@@H]4CCCC[C@H]4O)sc3c2)ccn1]

In embodiments, a CAR-expressing cell described herein is administered to a subject in combination with an agent that inhibits or reduces the activity of immunosuppressive plasma cells. Immunosuppressive plasma cells have been shown to impede T cell-dependent immunogenic chemotherapy, such as oxaliplatin (Shalapour et al., Nature 2015, 521:94-101). In an embodiment, immunosuppressive plasma cells can express one or more of IgA, interleukin (IL)-10, and PD-L1. In an embodiment, the agent is a CD19 CAR-expressing cell or a BCMA CAR-expressing cell.

In some embodiments, a CAR-expressing cell described herein is administered to a subject in combination with a interleukin-15 (IL-15) polypeptide, a interleukin-15 receptor alpha (IL-15Ra) polypeptide, or a combination of both a IL-15 polypeptide and a IL-15Ra polypeptide e.g., hetIL-15 (Admune Therapeutics, LLC). hetIL-15 is a heterodimeric non-covalent complex of IL-15 and IL-15Ra. hetIL-15 is described in, e.g., U.S. Pat. No. 8,124,084, U.S. 2012/0177598, U.S. 2009/0082299, U.S. 2012/0141413, and U.S. 2011/0081311, incorporated herein by reference. In embodiments, het-IL-15 is administered subcutaneously. In embodiments, the subject has a cancer, e.g., solid cancer, e.g., melanoma or colon cancer. In embodiments, the subject has a metastatic cancer.

In embodiments, a subject having a disease described herein, e.g., a hematological disorder, e.g., AML or MDS, is administered a CAR-expressing cell described herein in combination with an agent, e.g., cytotoxic or chemotherapy agent, a biologic therapy (e.g., antibody, e.g., monoclonal antibody, or cellular therapy), or an inhibitor (e.g., kinase inhibitor). In embodiments, the subject is administered a CAR-expressing cell described herein in combination with a cytotoxic agent, e.g., CPX-351 (Celator Pharmaceuticals), cytarabine, daunorubicin, vosaroxin (Sunesis Pharmaceuticals), sapacitabine (Cyclacel Pharmaceuticals), idarubicin, or mitoxantrone. CPX-351 is a liposomal formulation comprising cytarabine and daunorubicin at a 5:1 molar ratio. In embodiments, the subject is administered a CAR-expressing cell described herein in combination with a hypomethylating agent, e.g., a DNA methyltransferase inhibitor, e.g., azacitidine or decitabine. In embodiments, the subject is administered a CAR-expressing cell described herein in combination with a biologic therapy, e.g., an antibody or cellular therapy, e.g., 225Ac-lintuzumab (Actimab-A; Actinium Pharmaceuticals), IPH2102 (Innate Pharma/Bristol Myers Squibb), SGN-CD33A (Seattle Genetics), or gemtuzumab ozogamicin (Mylotarg; Pfizer). SGN-CD33A is an antibody-drug conjugate (ADC) comprising a pyrrolobenzodiazepine dimer that is attached to an anti-CD33 antibody. Actimab-A is an anti-CD33 antibody (lintuzumab) labeled with actinium. IPH2102 is a monoclonal antibody that targets killer immunoglobulin-like receptors (KIRs). In embodiments, the subject is administered a CAR-expressing cell described herein in combination with a FLT3 inhibitor, e.g., sorafenib (Bayer), midostaurin (Novartis), quizartinib (Daiichi Sankyo), crenolanib (Arog Pharmaceuticals), PLX3397 (Daiichi Sankyo), AKN-028 (Akinion Pharmaceuticals), or ASP2215 (Astellas). In embodiments, the subject is administered a CAR-expressing cell described herein in combination with an isocitrate dehydrogenase (IDH) inhibitor, e.g., AG-221 (Celgene/Agios) or AG-120 (Agios/Celgene). In embodiments, the subject is administered a CAR-expressing cell described herein in combination with a cell cycle regulator, e.g., inhibitor of polo-like kinase 1 (Plk1), e.g., volasertib (Boehringer Ingelheim); or an inhibitor of cyclin-dependent kinase 9 (Cdk9), e.g., alvocidib (Tolero Pharmaceuticals/Sanofi Aventis). In embodiments, the subject is administered a CAR-expressing cell described herein in combination with a B cell receptor signaling network inhibitor, e.g., an inhibitor of B-cell lymphoma 2 (Bcl-2), e.g., venetoclax (Abbvie/Roche); or an inhibitor of Bruton's tyrosine kinase (Btk), e.g., ibrutinib (Pharmacyclics/Johnson & Johnson Janssen Pharmaceutical). In embodiments, the subject is administered a CAR-expressing cell described herein in combination with an inhibitor of M1 aminopeptidase, e.g., tosedostat (CTI BioPharma/Vernalis); an inhibitor of histone deacetylase (HDAC), e.g., pracinostat (MEI Pharma); a multi-kinase inhibitor, e.g., rigosertib (Onconova Therapeutics/Baxter/SymBio); or a peptidic CXCR4 inverse agonist, e.g., BL-8040 (BioLineRx).

In another embodiment, the subjects receive an infusion of the CAR-expressing cell compositions of the present invention prior to transplantation, e.g., allogeneic stem cell transplant, of cells. In a preferred embodiment, CAR expressing cells transiently express a NKR-CAR, e.g., a KIR-CAR, e.g., by electroporation of an mRNA encoding a NKR-CAR, e.g., a KIR-CAR, whereby the expression of the tumor antigen is terminated prior to infusion of donor stem cells to avoid engraftment failure.

Some patients may experience allergic reactions to the compounds of the present invention and/or other anti-cancer agent(s) during or after administration; therefore, anti-allergic agents are often administered to minimize the risk of an allergic reaction. Suitable anti-allergic agents include corticosteroids, such as dexamethasone (e.g., Decadron®), beclomethasone (e.g., Beclovent®), hydrocortisone (also known as cortisone, hydrocortisone sodium succinate, hydrocortisone sodium phosphate, and sold under the tradenames Ala-Cort®, hydrocortisone phosphate, Solu-Cortef®, Hydrocort Acetate® and Lanacort®), prednisolone (sold under the tradenames Delta-Cortel®, Orapred®, Pediapred® and Prelone®), prednisone (sold under the tradenames Deltasone®, Liquid Red®, Meticorten® and Orasone®), methylprednisolone (also known as 6-methylprednisolone, methylprednisolone acetate, methylprednisolone sodium succinate, sold under the tradenames Duralone®, Medralone®, Medrol®, M-Prednisol® and Solu-Medrol®); antihistamines, such as diphenhydramine (e.g., Benadryl®), hydroxyzine, and cyproheptadine; and bronchodilators, such as the beta-adrenergic receptor agonists, albuterol (e.g., Proventil®), and terbutaline (Brethine®).

Some patients may experience nausea during and after administration of the compound of the present invention and/or other anti-cancer agent(s); therefore, anti-emetics are used in preventing nausea (upper stomach) and vomiting. Suitable anti-emetics include aprepitant (Emend®), ondansetron (Zofran®), granisetron HCl (Kytril®), lorazepam (Ativan®. dexamethasone (Decadron®), prochlorperazine (Compazine®), casopitant (Rezonic® and Zunrisa®), and combinations thereof.

Medication to alleviate the pain experienced during the treatment period is often prescribed to make the patient more comfortable. Common over-the-counter analgesics, such Tylenol®, are often used. However, opioid analgesic drugs such as hydrocodone/paracetamol or hydrocodone/acetaminophen (e.g., Vicodin®), morphine (e.g., Astramorph® or Avinza®), oxycodone (e.g., OxyContin® or Percocet®), oxymorphone hydrochloride (Opana®), and fentanyl (e.g., Duragesic®) are also useful for moderate or severe pain.

In an effort to protect normal cells from treatment toxicity and to limit organ toxicities, cytoprotective agents (such as neuroprotectants, free-radical scavengers, cardioprotectors, anthracycline extravasation neutralizers, nutrients and the like) may be used as an adjunct therapy. Suitable cytoprotective agents include Amifostine (Ethyol®), glutamine, dimesna (Tavocept®), mesna (Mesnex®), dexrazoxane (Zinecard® or Totect®), xaliproden (Xaprila®), and leucovorin (also known as calcium leucovorin, citrovorum factor and folinic acid).

The structure of the active compounds identified by code numbers, generic or trade names may be taken from the actual edition of the standard compendium "The Merck Index" or from databases, e.g. Patents International (e.g. IMS World Publications).

The above-mentioned compounds, which can be used in combination with a compound of the present invention, can be prepared and administered as described in the art, such as in the documents cited above.

In one embodiment, the present invention provides pharmaceutical compositions comprising at least one compound of the present invention (e.g., a compound of the present invention) or a pharmaceutically acceptable salt thereof together with a pharmaceutically acceptable carrier suitable for administration to a human or animal subject, either alone or together with other anti-cancer agents.

In one embodiment, the present invention provides methods of treating human or animal subjects suffering from a cellular proliferative disease, such as cancer. The present invention provides methods of treating a human or animal subject in need of such treatment, comprising administering to the subject a therapeutically effective amount of a compound of the present invention (e.g., a compound of the present invention) or a pharmaceutically acceptable salt thereof, either alone or in combination with other anti-cancer agents.

In particular, compositions will either be formulated together as a combination therapeutic or administered separately.

In combination therapy, the compound of the present invention and other anti-cancer agent(s) may be administered either simultaneously, concurrently or sequentially with no specific time limits, wherein such administration provides therapeutically effective levels of the two compounds in the body of the patient.

In a preferred embodiment, the compound of the present invention and the other anti-cancer agent(s) is generally administered sequentially in any order by infusion or orally. The dosing regimen may vary depending upon the stage of the disease, physical fitness of the patient, safety profiles of the individual drugs, and tolerance of the individual drugs, as well as other criteria well-known to the attending physician and medical practitioner(s) administering the combination. The compound of the present invention and other anti-cancer agent(s) may be administered within minutes of each other, hours, days, or even weeks apart depending upon the particular cycle being used for treatment. In addition, the cycle could include administration of one drug more often than the other during the treatment cycle and at different doses per administration of the drug.

In another aspect of the present invention, kits that include one or more compound of the present invention and a combination partner as disclosed herein are provided. Representative kits include (a) a compound of the present invention or a pharmaceutically acceptable salt thereof, (b) at least one combination partner, e.g., as indicated above, whereby such kit may comprise a package insert or other labeling including directions for administration.

A compound of the present invention may also be used to advantage in combination with known therapeutic processes, for example, the administration of hormones or especially radiation. A compound of the present invention may in particular be used as a radiosensitizer, especially for the treatment of tumors which exhibit poor sensitivity to radiotherapy.

In one embodiment, the subject can be administered an agent which reduces or ameliorates a side effect associated with the administration of a CAR-expressing cell. Side effects associated with the administration of a CAR-expressing cell include, but are not limited to CRS, and hemophagocytic lymphohistiocytosis (HLH), also termed Macrophage Activation Syndrome (MAS). Symptoms of CRS include high fevers, nausea, transient hypotension, hypoxia, and the like. CRS may include clinical constitutional signs and symptoms such as fever, fatigue, anorexia, myalgias, arthalgias, nausea, vomiting, and headache. CRS may include clinical skin signs and symptoms such as rash. CRS may include clinical gastrointestinal signs and symptoms such as nausea, vomiting and diarrhea. CRS may include clinical respiratory signs and symptoms such as tachypnea and hypoxemia. CRS may include clinical cardiovascular signs and symptoms such as tachycardia, widened pulse pressure, hypotension, increased cardac output (early) and potentially diminished cardiac output (late). CRS may include clinical coagulation signs and symptoms such as elevated d-dimer, hypofibrinogenemia with or without bleeding. CRS may include clinical renal signs and symptoms such as azotemia. CRS may include clinical hepatic signs and symptoms such as transaminitis and hyperbilirubinemia. CRS may include clinical neurologic signs and symptoms such as headache, mental status changes, confusion, delirium, word finding difficulty or frank aphasia, hallucinations, tremor, dymetria, altered gait, and seizures.

Accordingly, the methods described herein can comprise administering a CAR-expressing cell described herein to a subject and further administering one or more agents to manage elevated levels of a soluble factor resulting from treatment with a CAR-expressing cell. In one embodiment, the soluble factor elevated in the subject is one or more of IFN-γ, TNFα, IL-2 and IL-6. In an embodiment, the factor elevated in the subject is one or more of IL-1, GM-CSF, IL-10, IL-8, IL-5 and fraktalkine. Therefore, an agent administered to treat this side effect can be an agent that neutralizes one or more of these soluble factors. In one embodiment, the agent that neutralizes one or more of these soluble forms is an antibody or antigen binding fragment thereof. Examples of such agents include, but are not limited to a steroid (e.g., corticosteroid), an inhibitor of TNFα, and an inhibitor of IL-6. An example of a TNFα inhibitor is an anti-TNFα antibody molecule such as, infliximab, adalimumab, certolizumab pegol, and golimumab. Another example of a TNFα inhibitor is a fusion protein such as entanercept. Small molecule inhibitor of TNFα include, but are not limited to, xanthine derivatives (e.g. pentoxifylline) and bupropion. An example of an IL-6 inhibitor is an anti-IL-6 antibody molecule such as tocilizumab (toc), sarilumab, elsilimomab, CNTO 328, ALD518/BMS-945429, CNTO 136, CPSI-2364, CDP6038, VX30, ARGX-109, FE301, and FM101. In one embodiment, the anti-IL-6 antibody molecule is tocilizumab. An example of an IL-1R based inhibitor is anakinra.

In some embodiment, the subject is administered a corticosteroid, such as, e.g., methylprednisolone, hydrocortisone, among others.

In some embodiments, the subject is administered a vasopressor, such as, e.g., norepinephrine, dopamine, phenylephrine, epinephrine, vasopressin, or a combination thereof.

In an embodiment, the subject can be administered an antipyretic agent. In an embodiment, the subject can be administered an analgesic agent.

In one embodiment, the subject can be administered an agent which enhances the activity of a CAR-expressing cell. For example, in one embodiment, the agent can be an agent which inhibits an inhibitory molecule, e.g., the agent is a checkpoint inhibitor. Inhibitory molecules, e.g., Programmed Death 1 (PD1), can, in some embodiments, decrease the ability of a CAR-expressing cell to mount an immune effector response. Examples of inhibitory molecules include PD1, PD-L1, CTLA4, TIM3, LAG3, VISTA, BTLA, TIGIT, LAIR1, CD160, 2B4 and TGFR beta. Inhibition of an inhibitory molecule, e.g., by inhibition at the DNA, RNA or protein level, can optimize a CAR-expressing cell performance. In embodiments, an inhibitory nucleic acid, e.g., an inhibitory nucleic acid, e.g., a dsRNA, e.g., an siRNA or shRNA, a clustered regularly interspaced short palindromic repeats (CRISPR), a transcription-activator like effector nuclease (TALEN), or a zinc finger endonuclease (ZFN), e.g., as described herein, can be used to inhibit expression of an inhibitory molecule in the CAR-expressing cell. In an embodiment the inhibitor is an shRNA. In an embodiment, the inhibitory molecule is inhibited within a CAR-expressing cell. In these embodiments, a dsRNA molecule that inhibits expression of the inhibitory molecule is linked to the nucleic acid that encodes a component, e.g., all of the components, of the CAR.

In an embodiment, a nucleic acid molecule that encodes a dsRNA molecule that inhibits expression of the molecule that modulates or regulates, e.g., inhibits, T-cell function is operably linked to a promoter, e.g., a H1- or a U6-derived promoter such that the dsRNA molecule that inhibits expression of the molecule that modulates or regulates, e.g., inhibits, T-cell function is expressed, e.g., is expressed within a CAR-expressing cell. See e.g., Tiscornia G., "Development of Lentiviral Vectors Expressing siRNA," Chapter 3, in *Gene Transfer: Delivery and Expression of DNA and RNA* (eds. Friedmann and Rossi). Cold Spring Harbor Laboratory Press, Cold Spring Harbor, N.Y., USA, 2007; Brummelkamp T R, et al. (2002) *Science* 296: 550-553; Miyagishi M, et al. (2002) *Nat. Biotechnol.* 19: 497-500. In an embodiment the nucleic acid molecule that encodes a dsRNA molecule that inhibits expression of the molecule that modulates or regulates, e.g., inhibits, T-cell function is present on the same vector, e.g., a lentiviral vector, that comprises a nucleic acid molecule that encodes a component, e.g., all of the components, of the CAR. In such an embodiment, the nucleic acid molecule that encodes a dsRNA molecule that inhibits expression of the molecule that modulates or regulates, e.g., inhibits, T-cell function is located on the vector, e.g., the lentiviral vector, 5'- or 3'- to the nucleic acid that encodes a component, e.g., all of the components, of the CAR. The nucleic acid molecule that encodes a dsRNA molecule that inhibits expression of the molecule that modulates or regulates, e.g., inhibits, T-cell function can be transcribed in the same or different direction as the nucleic acid that encodes a component, e.g., all of the components, of the CAR.

In an embodiment the nucleic acid molecule that encodes a dsRNA molecule that inhibits expression of the molecule that modulates or regulates, e.g., inhibits, T-cell function is present on a vector other than the vector that comprises a nucleic acid molecule that encodes a component, e.g., all of the components, of the CAR. In an embodiment, the nucleic acid molecule that encodes a dsRNA molecule that inhibits expression of the molecule that modulates or regulates, e.g., inhibits, T-cell function it transiently expressed within a CAR-expressing cell. In an embodiment, the nucleic acid molecule that encodes a dsRNA molecule that inhibits expression of the molecule that modulates or regulates, e.g., inhibits, T-cell function is stably integrated into the genome of a CAR-expressing cell. FIGS. 44A-44E depicts examples of vectors for expressing a component, e.g., all of the components, of the CAR with a dsRNA molecule that inhibits expression of the molecule that modulates or regulates, e.g., inhibits, T-cell function.

Examples of dsRNA molecules useful for inhibiting expression of a molecule that modulates or regulates, e.g., inhibits, T-cell function, wherein the molecule that modulates or regulates, e.g., inhibits, T-cell function is PD-1 are provided below.

Provided in Table 7 below are the names of PDCD1 (PD1) RNAi agents (derived from their position in the mouse PDCD1 gene sequence NM_008798.2), along with the SEQ ID NOs: 216-263 representing the DNA sequence. Both sense (S) and antisense (AS) sequences are presented as 19mer and 21mer sequences are in this table. Also note that the position (PoS, e.g., 176) is derived from the position number in the mouse PDCD1 gene sequence NM_008798.2. SEQ ID NOs are indicated in groups of 12 that correspond with "sense 19" SEQ ID NOs: 65-76; "sense 21" SEQ ID NOs: 77-88; "asense 21" SEQ ID NOs: 89-100; "asense 19" SEQ ID NOs: 101-112.

TABLE 7

Mouse PDCD1 (PD1) shRNA sequences

| Position on NM_008798.2 | Target region | Sense19 | Sense21 | Asense21 | Asense19 |
|---|---|---|---|---|---|
| 176 | CDS | GGAGGTCCCTC ACCTTCTA (SEQ ID NO: 65) | CTGGAGGTCCC TCACCTTCTA (SEQ ID NO: 77) | TAGAAGGTGAG GGACCTCCAG (SEQ ID NO: 89) | TAGAAGGTGAG GGACCTCC (SEQ ID NO: 101) |
| 260 | CDS | CGGAGGATCTT ATGCTGAA (SEQ ID NO: 66) | GTCGGAGGATC TTATGCTGAA (SEQ ID NO: 78) | TTCAGCATAAG ATCCTCCGAC (SEQ ID NO: 90) | TTCAGCATAAG ATCCTCCG (SEQ ID NO: 102) |

TABLE 7-continued

Mouse PDCD1 (PD1) shRNA sequences

| Position on NM_008798.2 | Target region | Sense19 | Sense21 | Asense21 | Asense19 |
|---|---|---|---|---|---|
| 359 | CDS | CCCGCTTCCAG ATCATACA (SEQ ID NO: 67) | TGCCCGCTTCC AGATCATACA (SEQ ID NO: 79) | TGTATGATCTG GAAGCGGGCA (SEQ ID NO: 91) | TGTATGATCTG GAAGCGGG (SEQ ID NO: 103) |
| 528 | CDS | GGAGACCTCAA CAAGATAT (SEQ ID NO: 68) | CTGGAGACCTC AACAAGATAT (SEQ ID NO: 80) | ATATCTTGTTGA GGTCTCCAG (SEQ ID NO: 92) | ATATCTTGTTG AGGTCTCC (SEQ ID NO: 104) |
| 581 | CDS | AAGGCATGGTC ATTGGTAT (SEQ ID NO: 69) | TCAAGGCATGG TCATTGGTAT (SEQ ID NO: 81) | ATACCAATGAC CATGCCTTGA (SEQ ID NO: 93) | ATACCAATGAC CATGCCTT (SEQ ID NO: 105) |
| 584 | CDS | GCATGGTCATT GGTATCAT (SEQ ID NO: 70) | AGGCATGGTCA TTGGTATCAT (SEQ ID NO: 82) | ATGATACCAAT GACCATGCCT (SEQ ID NO: 94) | ATGATACCAAT GACCATGC (SEQ ID NO: 106) |
| 588 | CDS | GGTCATTGGTA TCATGAGT (SEQ ID NO: 71) | ATGGTCATTGG TATCATGAGT (SEQ ID NO: 83) | ATGGTCATTGG TATCATGAGT (SEQ ID NO: 95) | ATGGTCATTGG TATCATGA (SEQ ID NO: 107) |
| 609 | CDS | CCTAGTGGGTA TCCCTGTA (SEQ ID NO: 72) | GCCCTAGTGGG TATCCCTGTA (SEQ ID NO: 84) | GCCCTAGTGGG TATCCCTGTA (SEQ ID NO: 96) | GCCCTAGTGGG TATCCCTG (SEQ ID NO: 108) |
| 919 | CDS | GAGGATGGACA TTGTTCTT (SEQ ID NO: 73) | ATGAGGATGGA CATTGTTCTT (SEQ ID NO: 85) | ATGAGGATGGA CATTGTTCTT (SEQ ID NO: 97) | ATGAGGATGGA CATTGTTC (SEQ ID NO: 109) |
| 1021 | 3'UTR | GCATGCAGGCT ACAGTTCA (SEQ ID NO: 74) | GAGCATGCAGG CTACAGTTCA (SEQ ID NO: 86) | GAGCATGCAGG CTACAGTTCA (SEQ ID NO: 98) | GAGCATGCAGG CTACAGTT (SEQ ID NO: 110) |
| 1097 | 3'UTR | CCAGCACATGC ACTGTTGA (SEQ ID NO: 75) | TTCCAGCACAT GCACTGTTGA (SEQ ID NO: 87) | TTCCAGCACAT GCACTGTTGA (SEQ ID NO: 99) | TTCCAGCACAT GCACTGTT (SEQ ID NO: 111) |
| 1101 | 3'UTR | CACATGCACTG TTGAGTGA (SEQ ID NO: 76) | AGCACATGCAC TGTTGAGTGA (SEQ ID NO: 88) | AGCACATGCAC TGTTGAGTGA (SEQ ID NO: 100) | AGCACATGCAC TGTTGAGT (SEQ ID NO: 112) |

Provided in Table 8 below are the names of PDCD1 (PD1) RNAi agents (derived from their position in the human PDCD1 gene sequence, along with the SEQ ID NOs. 264-311 representing the DNA sequence. Both sense (S) and antisense (AS) sequences are presented as 19mer and 21mer sequences. SEQ ID NOs are indicated in groups of 12 that correspond with "sense 19" SEQ ID NOs: 113-124; "sense 21" SEQ ID NOs: 125-136; "asense 21" SEQ ID NOs: 137-148; "asense 19" SEQ ID NOs: 149-160.

TABLE 8

Human PDCD1 (PD1) shRNA sequences

| Position on NM_005018.2 | Target region | Sense19 | Asense19 | Sense21 | Asense21 |
|---|---|---|---|---|---|
| 145 | CDS | GGCCAGGATGG TTCTTAGA (SEQ ID NO: 113) | TCTAAGAACCA TCCTGGCC (SEQ ID NO: 125) | GCGGCCAGGAT GGTTCTTAGA (SEQ ID NO: 137) | TCTAAGAACCA TCCTGGCCGC (SEQ ID NO: 149) |
| 271 | CDS | GCTTCGTGCTA AACTGGTA (SEQ ID NO: 114) | TACCAGTTTAG CACGAAGC (SEQ ID NO: 126) | GAGCTTCGTGC TAAACTGGTA (SEQ ID NO: 138) | TACCAGTTTAG CACGAAGCTC (SEQ ID NO: 150) |
| 393 | CDS | GGGCGTGACTT CCACATGA (SEQ ID NO: 115) | TCATGTGGAAG TCACGCCC (SEQ ID NO: 127) | ACGGGCGTGAC TTCCACATGA (SEQ ID NO: 139) | TCATGTGGAAG TCACGCCCGT (SEQ ID NO: 151) |
| 1497 | 3'UTR | CAGGCCTAGAG AAGTTTCA (SEQ ID NO: 116) | TGAAACTTCTC TAGGCCTG (SEQ ID NO: 128) | TGCAGGCCTAG AGAAGTTTCA (SEQ ID NO: 140) | TGAAACTTCTC TAGGCCTGCA (SEQ ID NO: 152) |

TABLE 8-continued

Human PDCD1 (PD1) shRNA sequences

| Position on NM_005018.2 | Target region | Sense19 | Asense19 | Sense21 | Asense21 |
|---|---|---|---|---|---|
| 1863 | 3'UTR | CTTGGAACCCATTCCTGAA (SEQ ID NO: 117) | TTCAGGAATGGGTTCCAAG (SEQ ID NO: 129) | TCCTTGGAACCCATTCCTGAA (SEQ ID NO: 141) | TTCAGGAATGGGTTCCAAGGA (SEQ ID NO: 153) |
| 1866 | 3'UTR | GGAACCCATTCCTGAAATT (SEQ ID NO: 118) | AATTTCAGGAATGGGTTCC (SEQ ID NO: 130) | TTGGAACCCATTCCTGAAATT (SEQ ID NO: 142) | AATTTCAGGAATGGGTTCCAA (SEQ ID NO: 154) |
| 1867 | 3'UTR | GAACCCATTCCTGAAATTA (SEQ ID NO: 119) | TAATTTCAGGAATGGGTTC (SEQ ID NO: 131) | TGGAACCCATTCCTGAAATTA (SEQ ID NO: 143) | TAATTTCAGGAATGGGTTCCA (SEQ ID NO: 155) |
| 1868 | 3'UTR | AACCCATTCCTGAAATTAT (SEQ ID NO: 120) | ATAATTTCAGGAATGGGTT (SEQ ID NO: 132) | GGAACCCATTCCTGAAATTAT (SEQ ID NO: 144) | ATAATTTCAGGAATGGGTTCC (SEQ ID NO: 156) |
| 1869 | 3'UTR | ACCCATTCCTGAAATTATT (SEQ ID NO: 121) | AATAATTTCAGGAATGGGT (SEQ ID NO: 133) | GAACCCATTCCTGAAATTATT (SEQ ID NO: 145) | AATAATTTCAGGAATGGGTTC (SEQ ID NO: 157) |
| 1870 | 3'UTR | CCCATTCCTGAAATTATTT (SEQ ID NO: 122) | AAATAATTTCAGGAATGGG (SEQ ID NO: 134) | AACCCATTCCTGAAATTATTT (SEQ ID NO: 146) | AAATAATTTCAGGAATGGGTT (SEQ ID NO: 158) |
| 2079 | 3'UTR | CTGTGGTTCTATTATATTA (SEQ ID NO: 123) | TAATATAATAGAACCACAG (SEQ ID NO: 135) | CCCTGTGGTTCTATTATATTA (SEQ ID NO: 147) | TAATATAATAGAACCACAGGG (SEQ ID NO: 159) |
| 2109 | 3'UTR | AAATATGAGAGCATGCTAA (SEQ ID NO: 124) | TTAGCATGCTCTCATATTT (SEQ ID NO: 136) | TTAAATATGAGAGCATGCTAA (SEQ ID NO: 148) | TTAGCATGCTCTCATATTTAA (SEQ ID NO: 160) |

In one embodiment, the inhibitor of an inhibitory signal can be, e.g., an antibody or antibody fragment that binds to an inhibitory molecule. For example, the agent can be an antibody or antibody fragment that binds to PD1, PD-L1, PD-L2 or CTLA4 (e.g., ipilimumab (also referred to as MDX-010 and MDX-101, and marketed as Yervoy®; Bristol-Myers Squibb; Tremelimumab (IgG2 monoclonal antibody available from Pfizer, formerly known as ticilimumab, CP-675,206).). In an embodiment, the agent is an antibody or antibody fragment that binds to TIM3. In an embodiment, the agent is an antibody or antibody fragment that binds to LAG3. In embodiments, the agent that enhances the activity of a CAR-expressing cell, e.g., inhibitor of an inhibitory molecule, is administered in combination with an allogeneic CAR, e.g., an allogeneic CAR described herein (e.g., described in the Allogeneic CAR section herein).

PD-1 is an inhibitory member of the CD28 family of receptors that also includes CD28, CTLA-4, ICOS, and BTLA. PD-1 is expressed on activated B cells, T cells and myeloid cells (Agata et al. 1996 Int. Immunol 8:765-75). Two ligands for PD-1, PD-L1 and PD-L2 have been shown to downregulate T cell activation upon binding to PD-1 (Freeman et a. 2000 J Exp Med 192:1027-34; Latchman et al. 2001 Nat Immunol 2:261-8; Carter et al. 2002 Eur J Immunol 32:634-43). PD-L1 is abundant in human cancers (Dong et al. 2003 J Mol Med 81:281-7; Blank et al. 2005 Cancer Immunol. Immunother 54:307-314; Konishi et al. 2004 Clin Cancer Res 10:5094). Immune suppression can be reversed by inhibiting the local interaction of PD-1 with PD-L1.

Antibodies, antibody fragments, and other inhibitors of PD-1, PD-L1 and PD-L2 are available in the art and may be used combination with a cars of the present invention described herein. For example, nivolumab (also referred to as BMS-936558 or MDX1106; Bristol-Myers Squibb) is a fully human IgG4 monoclonal antibody which specifically blocks PD-1. Nivolumab (clone 5C4) and other human monoclonal antibodies that specifically bind to PD-1 are disclosed in U.S. Pat. No. 8,008,449 and WO2006/121168. Pidilizumab (CT-011; Cure Tech) is a humanized IgG1k monoclonal antibody that binds to PD-1. Pidilizumab and other humanized anti-PD-1 monoclonal antibodies are disclosed in WO2009/101611. Pembrolizumab (formerly known as lambrolizumab, and also referred to as MK03475; Merck) is a humanized IgG4 monoclonal antibody that binds to PD-1. Pembrolizumab and other humanized anti-PD-1 antibodies are disclosed in U.S. Pat. No. 8,354,509 and WO2009/114335. MEDI4736 (Medimmune) is a human monoclonal antibody that binds to PDL1, and inhibits interaction of the ligand with PD1. MDPL3280A (Genentech/Roche) is a human Fc optimized IgG1 monoclonal antibody that binds to PD-L1. MDPL3280A and other human monoclonal antibodies to PD-L1 are disclosed in U.S. Pat. No. 7,943,743 and U.S. Publication No.: 20120039906. Other anti-PD-L1 binding agents include YW243.55.S70 (heavy and light chain variable regions are shown in SEQ ID NOs 20 and 21 in WO2010/077634) and MDX-1 105 (also referred to as BMS-936559, and, e.g., anti-PD-L1 binding agents disclosed in WO2007/005874). AMP-224 (B7-DCIg; Amplimmune; e.g., disclosed in WO2010/027827 and WO2011/066342), is a PD-L2 Fc fusion soluble receptor that blocks the interaction between PD-1 and B7-H1. Other anti-PD-1 antibodies include AMP 514 (Amplimmune), among others, e.g., anti-PD-1 antibodies disclosed in U.S. Pat. No. 8,609,089, US 2010028330, and/or US 20120114649.

In one embodiment, the anti-PD-1 antibody or fragment thereof is an anti-PD-1 antibody molecule as described in US 2015/0210769, entitled "Antibody Molecules to PD-1 and Uses Thereof," incorporated by reference in its entirety. In one embodiment, the anti-PD-1 antibody molecule includes at least one, two, three, four, five or six CDRs (or collectively all of the CDRs) from a heavy and light chain variable region from an antibody chosen from any of BAP049-hum01, BAP049-hum02, BAP049-hum03, BAP049-hum04, BAP049-hum05, BAP049-hum06, BAP049-hum07, BAP049-hum08, BAP049-hum09, BAP049-hum10, BAP049-hum11, BAP049-hum12, BAP049-hum13, BAP049-hum14, BAP049-hum15, BAP049-hum16, BAP049-Clone-A, BAP049-Clone-B, BAP049-Clone-C, BAP049-Clone-D, or BAP049-Clone-E; or as described in Table 1 of US 2015/0210769, or encoded by the nucleotide sequence in Table 1, or a sequence substantially identical (e.g., at least 80%, 85%, 90%, 92%, 95%, 97%, 98%, 99% or higher identical) to any of the aforesaid sequences; or closely related CDRs, e.g., CDRs which are identical or which have at least one amino acid alteration, but not more than two, three or four alterations (e.g., substitutions, deletions, or insertions, e.g., conservative substitutions).

In yet another embodiment, the anti-PD-1 antibody molecule comprises at least one, two, three or four variable regions from an antibody described herein, e.g., an antibody chosen from any of BAP049-hum01, BAP049-hum02, BAP049-hum03, BAP049-hum04, BAP049-hum05, BAP049-hum06, BAP049-hum07, BAP049-hum08, BAP049-hum09, BAP049-hum10, BAP049-hum11, BAP049-hum12, BAP049-hum13, BAP049-hum14, BAP049-hum15, BAP049-hum16, BAP049-Clone-A, BAP049-Clone-B, BAP049-Clone-C, BAP049-Clone-D, or BAP049-Clone-E; or as described in Table 1 of US 2015/0210769, or encoded by the nucleotide sequence in Table 1; or a sequence substantially identical (e.g., at least 80%, 85%, 90%, 92%, 95%, 97%, 98%, 99% or higher identical) to any of the aforesaid sequences.

TIM3 (T cell immunoglobulin-3) also negatively regulates T cell function, particularly in IFN-g-secreting CD4+ T helper 1 and CD8+ T cytotoxic 1 cells, and plays a critical role in T cell exhaustion. Inhibition of the interaction between TIM3 and its ligands, e.g., galectin-9 (Gal9), phosphotidylserine (PS), and HMGB1, can increase immune response. Antibodies, antibody fragments, and other inhibitors of TIM3 and its ligands are available in the art and may be used combination with a CD19 CAR described herein. For example, antibodies, antibody fragments, small molecules, or peptide inhibitors that target TIM3 binds to the IgV domain of TIM3 to inhibit interaction with its ligands. Antibodies and peptides that inhibit TIM3 are disclosed in WO2013/006490 and US20100247521. Other anti-TIM3 antibodies include humanized versions of RMT3-23 (disclosed in Ngiow et al., 2011, Cancer Res, 71:3540-3551), and clone 8B.2C12 (disclosed in Monney et al., 2002, Nature, 415:536-541). Bi-specific antibodies that inhibit TIM3 and PD-1 are disclosed in US20130156774.

In one embodiment, the anti-TIM3 antibody or fragment thereof is an anti-TIM3 antibody molecule as described in US 2015/0218274, entitled "Antibody Molecules to TIM3 and Uses Thereof," incorporated by reference in its entirety. In one embodiment, the anti-TIM3 antibody molecule includes at least one, two, three, four, five or six CDRs (or collectively all of the CDRs) from a heavy and light chain variable region from an antibody chosen from any of ABTIM3, ABTIM3-hum01, ABTIM3-hum02, ABTIM3-hum03, ABTIM3-hum04, ABTIM3-hum05, ABTIM3-hum06, ABTIM3-hum07, ABTIM3-hum08, ABTIM3-hum09, ABTIM3-hum10, ABTIM3-hum11, ABTIM3-hum12, ABTIM3-hum13, ABTIM3-hum14, ABTIM3-hum15, ABTIM3-hum16, ABTIM3-hum17, ABTIM3-hum18, ABTIM3-hum19, ABTIM3-hum20, ABTIM3-hum21, ABTIM3-hum22, ABTIM3-hum23; or as described in Tables 1-4 of US 2015/0218274; or encoded by the nucleotide sequence in Tables 1-4; or a sequence substantially identical (e.g., at least 80%, 85%, 90%, 92%, 95%, 97%, 98%, 99% or higher identical) to any of the aforesaid sequences, or closely related CDRs, e.g., CDRs which are identical or which have at least one amino acid alteration, but not more than two, three or four alterations (e.g., substitutions, deletions, or insertions, e.g., conservative substitutions).

In yet another embodiment, the anti-TIM3 antibody molecule comprises at least one, two, three or four variable regions from an antibody described herein, e.g., an antibody chosen from any of ABTIM3, ABTIM3-hum01, ABTIM3-hum02, ABTIM3-hum03, ABTIM3-hum04, ABTIM3-hum05, ABTIM3-hum06, ABTIM3-hum07, ABTIM3-hum08, ABTIM3-hum09, ABTIM3-hum10, ABTIM3-hum11, ABTIM3-hum12, ABTIM3-hum13, ABTIM3-hum14, ABTIM3-hum15, ABTIM3-hum16, ABTIM3-hum17, ABTIM3-hum18, ABTIM3-hum19, ABTIM3-hum20, ABTIM3-hum21, ABTIM3-hum22, ABTIM3-hum23; or as described in Tables 1-4 of US 2015/0218274; or encoded by the nucleotide sequence in Tables 1-4; or a sequence substantially identical (e.g., at least 80%, 85%, 90%, 92%, 95%, 97%, 98%, 99% or higher identical) to any of the aforesaid sequences In other embodiments, the agent which enhances the activity of a CAR-expressing cell is a CEACAM inhibitor (e.g., CEACAM-1, CEACAM-3, and/or CEACAM-5 inhibitor). In one embodiment, the inhibitor of CEACAM is an anti-CEACAM antibody molecule. Exemplary anti-CEACAM-1 antibodies are described in WO 2010/125571, WO 2013/082366 WO 2014/059251 and WO 2014/022332, e.g., a monoclonal antibody 34B1, 26H7, and 5F4; or a recombinant form thereof, as described in, e.g., US 2004/0047858, U.S. Pat. No. 7,132,255 and WO 99/052552. In other embodiments, the anti-CEACAM antibody binds to CEACAM-5 as described in, e.g., Zheng et al. *PLoS One.* 2010 Sep. 2; 5(9). pii: e12529 (DOI:10.1371/journal.pone.0021146), or crossreacts with CEACAM-1 and CEACAM-5 as described in, e.g., WO 2013/054331 and US 2014/0271618.

Without wishing to be bound by theory, carcinoembryonic antigen cell adhesion molecules (CEACAM), such as CEACAM-1 and CEACAM-5, are believed to mediate, at least in part, inhibition of an anti-tumor immune response (see e.g., Markel et al. *J Immunol.* 2002 Mar. 15; 168(6): 2803-10; Markel et al. *J Immunol.* 2006 Nov. 1; 177(9): 6062-71; Markel et al. *Immunology.* 2009 February; 126(2): 186-200; Markel et al. *Cancer Immunol Immunother.* 2010 February; 59(2):215-30; Ortenberg et al. *Mol Cancer Ther.* 2012 June; 11(6):1300-10; Stem et al. *J Immunol.* 2005 Jun. 1; 174(11):6692-701; Zheng et al. *PLoS One.* 2010 Sep. 2; 5(9). pii: e12529). For example, CEACAM-1 has been described as a heterophilic ligand for TIM-3 and as playing a role in TIM-3-mediated T cell tolerance and exhaustion (see e.g., WO 2014/022332; Huang, et al. (2014) *Nature* doi:10.1038/nature13848). In embodiments, co-blockade of CEACAM-1 and TIM-3 has been shown to enhance an anti-tumor immune response in xenograft colorectal cancer models (see e.g., WO 2014/022332; Huang, et al. (2014), supra). In other embodiments, co-blockade of CEACAM-1 and PD-1 reduce T cell tolerance as described, e.g., in WO 2014/059251. Thus, CEACAM inhibitors can be used with the other immunomodulators described herein (e.g., anti-PD-1 and/or anti-TIM-3 inhibitors) to enhance an immune response against a cancer, e.g., a melanoma, a lung cancer (e.g., NSCLC), a bladder cancer, a colon cancer an ovarian cancer, and other cancers as described herein.

LAG3 (lymphocyte activation gene-3 or CD223) is a cell surface molecule expressed on activated T cells and B cells that has been shown to play a role in CD8+ T cell exhaustion. Antibodies, antibody fragments, and other inhibitors of LAG3 and its ligands are available in the art and may be used combination with a CD19 CAR described herein. For example, BMS-986016 (Bristol-Myers Squib) is a monoclonal antibody that targets LAG3. IMP701 (Immutep) is an antagonist LAG3 antibody and IMP731 (Immutep and GlaxoSmithKline) is a depleting LAG3 antibody. Other LAG3 inhibitors include IMP321 (Immutep), which is a recombinant fusion protein of a soluble portion of LAG3 and Ig that binds to MHC class II molecules and activates antigen presenting cells (APC), Other antibodies are disclosed, e.g., in WO02010/019570.

In some embodiments, the agent which enhances the activity of a CAR-expressing cell can be, e.g., a fusion protein comprising a first domain and a second domain, wherein the first domain is an inhibitory molecule, or fragment thereof, and the second domain is a polypeptide that is associated with a positive signal, e.g., a polypeptide comprising an antracellular signaling domain as described herein. In some embodiments, the polypeptide that is associated with a positive signal can include a costimulatory domain of CD28, CD27, ICOS, e.g., an intracellular signaling domain of CD28, CD27 and/or ICOS, and/or a primary signaling domain, e.g., of CD3 zeta, e.g., described herein. In one embodiment, the fusion protein is expressed by the same cell that expressed the CAR. In another embodiment, the fusion protein is expressed by a cell, e.g., a T cell that does not express a CAR In one embodiment, the agent which enhances activity of a CAR-expressing cell described herein is miR-17-92.

In one embodiment, the agent which enhances activity of a CAR-described herein is a cytokine. Cytokines have important functions related to T cell expansion, differentiation, survival, and homeostatis. Cytokines that can be administered to the subject receiving a CAR-expressing cell described herein include: IL-2, IL-4, IL-7, IL-9, IL-15, IL-18, and IL-21, or a combination thereof. In preferred embodiments, the cytokine administered is IL-7, IL-15, or IL-21, or a combination thereof. The cytokine can be administered once a day or more than once a day, e.g., twice a day, three times a day, or four times a day. The cytokine can be co-administered for more than one day, e.g. the cytokine is administered for 2 days, 3 days, 4 days, 5 days, 6 days, 1 week, 2 weeks, 3 weeks, or 4 weeks. For example, the cytokine is administered once a day for 7 days.

In embodiments, the cytokine is administered in combination with CAR-expressing T cells. The cytokine can be administered simultaneously or concurrently with the CAR-expressing T cells, e.g., administered on the same day. The cytokine may be prepared in the same pharmaceutical composition as the CAR-expressing T cells, or may be prepared in a separate pharmaceutical composition. Alternatively, the cytokine can be administered shortly after administration of the CAR-expressing T cells, e.g., 1 day, 2 days, 3 days, 4 days, 5 days, 6 days, or 7 days after administration of the CAR-expressing T cells. In embodiments where the cytokine is administered in a dosing regimen that occurs over more than one day, the first day of the cytokine dosing regimen can be on the same day as administration with the CAR-expressing T cells, or the first day of the cytokine dosing regimen can be 1 day, 2 days, 3 days, 4 days, 5 days, 6 days, or 7 days after administration of the CAR-expressing T cells. In one embodiment, on the first day, the CAR-expressing T cells are administered to the subject, and on the second day, a cytokine is administered once a day for the next 7 days. In a preferred embodiment, the cytokine to be administered in combination with CAR-expressing T cells is IL-7, IL-15, or IL-21.

In other embodiments, the cytokine is administered a period of time after administration of CAR-expressing cells, e.g., at least 2 weeks, 3 weeks, 4 weeks, 6 weeks, 8 weeks, 10 weeks, 12 weeks, 4 months, 5 months, 6 months, 7 months, 8 months, 9 months, 10 months, 11 months, or 1 year or more after administration of CAR-expressing cells. In one embodiment, the cytokine is administered after assessment of the subject's response to the CAR-expressing cells. For example, the subject is administered CAR-expressing cells according to the dosage and regimens described herein. The response of the subject to CAR-expressing cell therapy is assessed at 2 weeks, 3 weeks, 4 weeks, 6 weeks, 8 weeks, 10 weeks, 12 weeks, 4 months, 5 months, 6 months, 7 months, 8 months, 9 months, 10 months, 11 months, or 1 year or more after administration of CAR-expressing cells, using any of the methods described herein, including inhibition of tumor growth, reduction of circulating tumor cells, or tumor regression. Subjects that do not exhibit a sufficient response to CAR-expressing cell therapy can be administered a cytokine. Administration of the cytokine to the subject that has sub-optimal response to the CAR-expressing cell therapy improves CAR-expressing cell efficacy or anti-cancer activity. In a preferred embodiment, the cytokine administered after administration of CAR-expressing cells is IL-7.

Combination with CD19 Inhibitors

The methods and compositions disclosed herein can be used in combination with a CD19 inhibitor. In some embodiments, the CAR-containing cells described herein, e.g., NKR-CAR-containing cells, and the CD19 inhibitor (e.g., one or more cells that express a CAR molecule that binds CD19, e.g., a CAR molecule that binds CD19 described herein) are administered simultaneously or concurrently, or sequentially.

In some embodiments, the CAR-containing cells described herein and the CD19 inhibitor are infused into a subject simultaneously or concurrently, e.g., are admixed in the same infusion volume. For example, a population of CAR-containing cells and CD19CAR-containing cells are mixed together. Alternatively, a population of cells co-expressing a CAR described herein and a CD19CAR is administered. In other embodiments, the simultaneous administration comprises separate administration of the CAR-containing cells and the CD19 inhibitor, e.g., within a predetermined time interval (e.g., within 15, 30, or 45 minutes of each other).

In some embodiments, the start of the CAR-containing cells and the start of the CD19 inhibitor are within 1, 2, 3, 4, 6, 12, 18, or 24 hours of each other, or within 1, 2, 3, 4, 5, 10, 15, 20, 25, 30, 35, 40, 60, 80, or 100 days of each other. In some embodiments, the end of the CAR-containing cells delivery and the end of the CD19 inhibitor delivery are within 1, 2, 3, 4, 6, 12, 18, or 24 hours of each other, or within 1, 2, 3, 4, 5, 10, 15, 20, 25, 30, 35, 40, 60, 80, or 100 days of each other. In some embodiments, the overlap in terms of administration between the of the CAR-containing cells delivery (e.g., infusion) and the end of CD19 inhibitor delivery (e.g., infusion) is at least 1, 2, 3, 4, 5, 10, 15, 20, 25, 30 minutes. In one embodiment, the CD19 inhibitor is administered prior to the CAR-containing cells. In other embodiments, the CAR-containing cells are administered prior to the CD19 inhibitor.

In some embodiments, the CAR-containing cells are administered while the CD19 inhibitor (e.g., one or more cells that express a CD19CAR molecule) is present (e.g., cells undergoing expansion) in the subject. In other embodiments, the CD19 inhibitor (e.g., one or more cells that express a CD19CAR molecule) is administered while the CAR-containing cells are present (e.g., cells undergoing expansion) in the subject.

A CD19 inhibitor includes, but is not limited to, a CD19 CAR-expressing cell, e.g., a CD19 CART cell, or an anti-CD19 antibody (e.g., an anti-CD19 mono- or bispecific antibody) or a fragment or conjugate thereof.

In one embodiment, a CAR-expressing cell described herein is administered to a subject in combination with a CD19 CAR-cell (e.g., CART cell) (e.g., CTL019, e.g., as described in WO2012/079000, incorporated herein by reference).

In other embodiments, the CAR-expressing cell described herein is administered to a subject in combination with a CD19 CAR-cell (e.g., CART cell) that includes a humanized antigen binding domain as described in WO2014/153270 (e.g., Table 3 of WO2014/153270), incorporated herein by reference.

The CD19 inhibitor (e.g., a first CD19 CAR-expressing cell) and a second CAR-expressing cell may be expressed by the same cell type or different types. For instance, in some embodiments, the cell expressing a CD19 CAR is a CD4+ T cell and the cell expressing a CAR described herein is a CD8+ T cell, or the cell expressing a CD19 CAR is a CD8+ T cell and the cell expressing a CAR described herein is a CD4+ T cell. In other embodiments, the cell expressing a CD19 CAR is a T cell and the cell expressing a CAR described herein is a NK cell, or the cell expressing a CD19 CAR is a NK cell and the cell expressing a CAR described herein is a T cell. In other embodiments, the cell expressing a CD19 CAR and the cell expressing a CAR described herein are both NK cells or are both T cells, e.g., are both CD4+ T cells, or are both CD8+ T cells. In yet other embodiments, a single cell expresses the CD19 CAR and CAR described herein, and this cell is, e.g., a NK cell or a T cell such as a CD4+ T cell or CD8+ T cell.

In embodiments, the subject has acute myeloid leukemia (AML), e.g., a CD19 positive AML or a CD19 negative AML. In embodiments, the subject has a CD19+ lymphoma, e.g., a CD19+ Non-Hodgkin's Lymphoma (NHL), a CD19+ FL, or a CD19+ DLBCL. In embodiments, the subject has a relapsed or refractory CD19+ lymphoma. In embodiments, a lymphodepleting chemotherapy is administered to the subject prior to, concurrently with, or after administration (e.g., infusion) of CD19 CART cells. In an example, the lymphodepleting chemotherapy is administered to the subject prior to administration of CD19 CART cells. For example, the lymphodepleting chemotherapy ends 1-4 days (e.g., 1, 2, 3, or 4 days) prior to CD19 CART cell infusion. In embodiments, multiple doses of CD19 CART cells are administered, e.g., as described herein. For example, a single dose comprises about $5 \times 10^8$ CD19 CART cells. In embodiments, a lymphodepleting chemotherapy is administered to the subject prior to, concurrently with, or after administration (e.g., infusion) of a CAR-expressing cell described herein, e.g., a non-CD19 CAR-expressing cell. In embodiments, a CD19 CART is administered to the subject prior to, concurrently with, or after administration (e.g., infusion) of a non-CD19 CAR-expressing cell, e.g., a non-CD19 CAR-expressing cell described herein.

In some embodiments, a CAR-expressing cell described herein is administered to a subject in combination with a CD19 CAR-expressing cell, e.g., CTL019, e.g., as described in WO2012/079000, incorporated herein by reference, for treatment of a disease associated with the expression of a tumor antigen described herein, e.g., a cancer described herein. Without being bound by theory, it is believed that administering a CD19 CAR-expressing cell in combination with a CAR-expressing cell improves the efficacy of a CAR-expressing cell described herein by targeting early lineage cancer cells, e.g., cancer stem cells, modulating the immune response, depleting regulatory B cells, and/or improving the tumor microenvironment. For example, a CD19 CAR-expressing cell targets cancer cells that express early lineage markers, e.g., cancer stem cells and CD19-expressing cells, while the CAR-expressing cell described herein targets cancer cells that express later lineage markers, e.g., CD123. This preconditioning approach can improve the efficacy of the CAR-expressing cell described herein. In such embodiments, the CD19 CAR-expressing cell is administered prior to, concurrently with, or after administration (e.g., infusion) of a CAR-expressing cell described herein.

In embodiments, a CAR-expressing cell described herein also expresses a CAR targeting CD19, e.g., a CD19 CAR. In an embodiment, the cell expressing a CAR described herein and a CD19 CAR is administered to a subject for treatment of a cancer described herein, e.g., AML. In an embodiment, the configurations of one or both of the CAR molecules comprise a primary intracellular signaling domain and a costimulatory signaling domain. In another embodiment, the configurations of one or both of the CAR molecules comprise a primary intracellular signaling domain and two or more, e.g., 2, 3, 4, or 5 or more, costimulatory signaling domains. In such embodiments, the CAR molecule described herein and the CD19 CAR may have the same or a different primary intracellular signaling domain, the same or different costimulatory signaling domains, or the same number or a different number of costimulatory signaling domains. Alternatively, the CAR described herein and the CD19 CAR are configured as a split CAR, in which one of the CAR molecules comprises an antigen binding domain and a costimulatory domain (e.g., 4-1BB), while the other CAR molecule comprises an antigen binding domain and a primary intracellular signaling domain (e.g., CD3 zeta).

In an embodiment, the CAR described herein and the second CAR, e.g., CD19 CAR, are on the same vector or are on two different vectors. In embodiments where the CAR described herein and the second CAR, e.g., CD19 CAR, are on the same vector, the nucleic acid sequences encoding the CAR described herein and the second CAR, e.g., CD19 CAR are in the same frame, and are separated by one or more peptide cleavage sites, e.g., P2A.

In other embodiments, the CAR-expressing cell disclosed herein is administered in combination with an anti-CD19 antibody inhibitor. In one embodiment, the anti-CD19 antibody is a humanized antigen binding domain as described in WO2014/153270 (e.g., Table 3 of WO2014/153270) incorporated herein by reference, or a conjugate thereof. Other exemplary anti-CD19 antibodies or fragments or conjugates thereof, include but are not limited to, blinatumomab, SAR3419 (Sanofi), MEDI-551 (MedImmune LLC), Combotox, DT2219ARL (Masonic Cancer Center), MOR-208 (also called XmAb-5574; MorphoSys), XmAb-5871 (Xencor), MDX-1342 (Bristol-Myers Squibb), SGN-CD19A (Seattle Genetics), and AFM11 (Affimed Therapeutics). See, e.g., Hammer. MAbs. 4.5(2012): 571-77. Blinatomomab is a bispecific antibody comprised of two scFvs-one that binds to CD19 and one that binds to CD3. Blinatomomab directs T cells to attack cancer cells. See, e.g., Hammer et al.; Clinical Trial Identifier No. NCT00274742 and NCT01209286. MEDI-551 is a humanized anti-CD19 antibody with a Fc engineered to have enhanced antibody-dependent cell-mediated cytotoxicity (ADCC). See, e.g., Hammer et al.; and Clinical Trial Identifier No. NCT01957579. Combotox is a mixture of immunotoxins that bind to CD19 and CD22. The immunotoxins are made up of scFv antibody fragments fused to a deglycosylated ricin A chain. See, e.g., Hammer et al.; and Herrera et al. J. Pediatr. Hematol. Oncol. 31.12(2009):936-41; Schindler et al. Br. J. Haematol. 154.4(2011):471-6. DT2219ARL is a bispecific immunotoxin targeting CD19 and CD22, comprising two scFvs and a truncated diphtheria toxin. See, e.g., Hammer et al.; and Clinical Trial Identifier No. NCT00889408. SGN-CD19A is an antibody-drug conjugate (ADC) comprised of an anti-CD19 humanized monoclonal antibody linked to a synthetic cytotoxic cell-killing agent, monomethyl auristatin F (MMAF). See, e.g., Hammer et al.; and Clinical Trial Identifier Nos. NCT01786096 and NCT01786135. SAR3419 is an anti-CD19 antibody-drug conjugate (ADC) comprising an anti-CD19 humanized monoclonal antibody conjugated to a maytansine derivative via a cleavable linker. See, e.g., Younes et al. J. Clin. Oncol. 30.2(2012): 2776-82; Hammer et al.; Clinical Trial Identifier No. NCT00549185; and Blanc et al. Clin Cancer Res. 2011; 17:6448-58. XmAb-5871 is an Fc-engineered, humanized anti-CD19 antibody. See, e.g., Hammer et al. MDX-1342 is a human Fc-engineered anti-CD19 antibody with enhanced ADCC. See, e.g., Hammer et al. In embodiments, the antibody molecule is a bispecific anti-CD19 and anti-CD3 molecule. For instance, AFM11 is a bispecific antibody that targets CD19 and CD3. See, e.g., Hammer et al.; and Clinical Trial Identifier No. NCT02106091. In some embodiments, an anti-CD19 antibody described herein is conjugated or otherwise bound to a therapeutic agent, e.g., a chemotherapeutic agent, peptide vaccine (such as that described in Izumoto et al. 2008 J Neurosurg 108:963-971), immunosuppressive agent, or immunoablative agent, e.g., cyclosporin, azathioprine, methotrexate, mycophenolate, FK506, CAMPATH, anti-CD3 antibody, cytoxin, fludarabine, rapamycin, mycophenolic acid, steroid, FR901228, or cytokine.

Combination with a Low Dose of an mTOR Inhibitor

Methods described herein use low, immune enhancing, doses of mTOR inhibitors, e.g., allosteric mTOR inhibitors, including rapalogs such as RAD001. Administration of a low, immune enhancing, dose of an mTOR inhibitor (e.g., a dose that is insufficient to completely suppress the immune system, but sufficient to improve immune function) can optimize the performance of immune effector cells, e.g., T cells or CAR-expressing cells, in the subject. Methods for measuring mTOR inhibition, dosages, treatment regimens, and suitable pharmaceutical compositions are described in U.S. Patent Application No. 2015/01240036, hereby incorporated by reference.

In an embodiment, administration of a low, immune enhancing, dose of an mTOR inhibitor can result in one or more of the following:
  i) a decrease in the number of PD-1 positive immune effector cells;
  ii) an increase in the number of PD-1 negative immune effector cells;
  iii) an increase in the ratio of PD-1 negative immune effector cells/PD-1 positive immune effector cells;
  iv) an increase in the number of naive T cells;
  v) an increase in the expression of one or more of the following markers: $CD62L^{high}$, $CD127^{high}$, $CD27^+$, and BCL2, e.g., on memory T cells, e.g., memory T cell precursors; vi) a decrease in the expression of KLRG1, e.g., on memory T cells, e.g., memory T cell precursors; or
  vii) an increase in the number of memory T cell precursors, e.g., cells with any one or combination of the following characteristics: increased $CD62L^{high}$, increased $CD127^{high}$, increased $CD27^+$, decreased KLRG1, and increased BCL2;
and wherein any of the foregoing, e.g., i), ii), iii), iv), v), vi), or vii), occurs e.g., at least transiently, e.g., as compared to a non-treated subject.

In another embodiment, administration of a low, immune enhancing, dose of an mTOR inhibitor results in increased or prolonged proliferation of CAR-expressing cells, e.g., in culture or in a subject, e.g., as compared to non-treated CAR-expressing cells or a non-treated subject. In embodiments, increased proliferation is associated with in an increase in the number of CAR-expressing cells. Methods for measuring increased or prolonged proliferation are described in Examples 9 and 10. In another embodiment, administration of a low, immune enhancing, dose of an mTOR inhibitor results in increased killing of cancer cells by CAR-expressing cells, e.g., in culture or in a subject, e.g., as compared to non-treated CAR-expressing cells or a non-treated subject. In embodiments, increased killing of cancer cells is associated with in a decrease in tumor volume. Methods for measuring increased killing of cancer cells are described in Example 2.

In one embodiment, the cells expressing a CAR molecule, e.g., a CAR molecule described herein, are administered in combination with a low, immune enhancing dose of an mTOR inhibitor, e.g., an allosteric mTOR inhibitor, e.g., RAD001, or a catalytic mTOR inhibitor. For example, administration of the low, immune enhancing, dose of the mTOR inhibitor can be initiated prior to administration of a CAR-expressing cell described herein; completed prior to administration of a CAR-expressing cell described herein; initiated at the same time as administration of a CAR-expressing cell described herein; overlapping with administration of a CAR-expressing cell described herein; or continuing after administration of a CAR-expressing cell described herein.

Alternatively or in addition, administration of a low, immune enhancing, dose of an mTOR inhibitor can optimize immune effector cells to be engineered to express a CAR molecule described herein. In such embodiments, administration of a low, immune enhancing, dose of an mTOR inhibitor, e.g., an allosteric inhibitor, e.g., RAD001, or a catalytic inhibitor, is initiated or completed prior to harvest of immune effector cells, e.g., T cells or NK cells, to be engineered to express a CAR molecule described herein, from a subject.

In another embodiment, immune effector cells, e.g., T cells or NK cells, to be engineered to express a CAR molecule described herein, e.g., after harvest from a subject, or CAR-expressing immune effector cells, e.g., T cells or NK cells, e.g., prior to administration to a subject, can be cultured in the presence of a low, immune enhancing, dose of an mTOR inhibitor.

In an embodiment, administering to the subject a low, immune enhancing, dose of an mTOR inhibitor comprises administering, e.g., once per week, e.g., in an immediate release dosage form, 0.1 to 20, 0.5 to 10, 2.5 to 7.5, 3 to 6, or about 5, mgs of RAD001, or a bioequivalent dose thereof. In an embodiment, administering to the subject a low, immune enhancing, dose of an mTOR inhibitor comprises administering, e.g., once per week, e.g., in a sustained release dosage form, 0.3 to 60, 1.5 to 30, 7.5 to 22.5, 9 to 18, or about 15 mgs of RAD001, or a bioequivalent dose thereof.

In an embodiment, a dose of an mTOR inhibitor is associated with, or provides, mTOR inhibition of at least 5 but no more than 90%, at least 10 but no more than 90%, at least 15, but no more than 90%, at least 20 but no more than 90%, at least 30 but no more than 90%, at least 40 but no more than 90%, at least 50 but no more than 90%, at least 60 but no more than 90%, at least 70 but no more than 90%, at least 5 but no more than 80%, at least 10 but no more than 80%, at least 15, but no more than 80%, at least 20 but no more than 80%, at least 30 but no more than 80%, at least 40 but no more than 80%, at least 50 but no more than 80%, at least 60 but no more than 80%, at least 5 but no more than 70%, at least 10 but no more than 70%, at least 15, but no more than 70%, at least 20 but no more than 70%, at least 30 but no more than 70%, at least 40 but no more than 70%, at least 50 but no more than 70%, at least 5 but no more than 60%, at least 10 but no more than 60%, at least 15, but no more than 60%, at least 20 but no more than 60%, at least 30 but no more than 60%, at least 40 but no more than 60%, at least 5 but no more than 50%, at least 10 but no more than 50%, at least 15, but no more than 50%, at least 20 but no more than 50%, at least 30 but no more than 50%, at least 40 but no more than 50%, at least 5 but no more than 40%, at least 10 but no more than 40%, at least 15, but no more than 40%, at least 20 but no more than 40%, at least 30 but no more than 40%, at least 35 but no more than 40%, at least 5 but no more than 30%, at least 10 but no more than 30%, at least 15, but no more than 30%, at least 20 but no more than 30%, or at least 25 but no more than 30%.

The extent of mTOR inhibition can be conveyed as, or corresponds to, the extent of P70 S6 kinase inhibition, e.g., the extent of mTOR inhibition can be determined by the level of decrease in P70 S6 kinase activity, e.g., by the decrease in phosphorylation of a P70 S6 kinase substrate. The level of mTOR inhibition can be evaluated by various methods, such as measuring P70 S6 kinase activity by the Boulay assay, as described in U.S. Patent Application No. 2015/0240036, hereby incorporated by reference, or as described in U.S. Pat. No. 7,727,950, hereby incorporated by reference; measuring the level of phosphorylated S6 by western blot; or evaluating a change in the ratio of PD1 negative immune effector cells to PD1 positive immune effector cells.

As used herein, the term "mTOR inhibitor" refers to a compound or ligand, or a pharmaceutically acceptable salt thereof, which inhibits the mTOR kinase in a cell. In an embodiment, an mTOR inhibitor is an allosteric inhibitor. Allosteric mTOR inhibitors include the neutral tricyclic compound rapamycin (sirolimus), rapamycin-related compounds, that is compounds having structural and functional similarity to rapamycin including, e.g., rapamycin derivatives, rapamycin analogs (also referred to as rapalogs) and other macrolide compounds that inhibit mTOR activity. In an embodiment, an mTOR inhibitor is a catalytic inhibitor.

Rapamycin is a known macrolide antibiotic produced by *Streptomyces hygroscopicus* having the structure shown in Formula A.

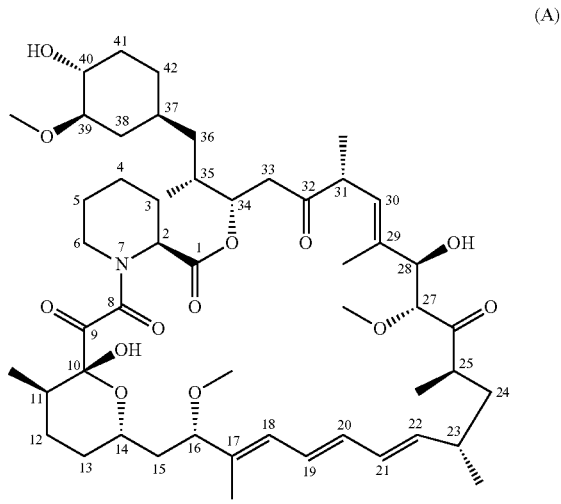 [SMILES: CO[C@H]1C[C@@H]2CC[C@@H](C)[C@@](O)(O2)C(=O)C(=O)N2CCCC[C@H]2C(=O)O[C@H]([C@H](C)C[C@@H]2CC[C@@H](O)[C@H](OC)C2)CC(=O)[C@H](C)/C=C(\C)[C@@H](O)[C@@H](OC)C(=O)[C@H](C)C[C@H](C)/C=C/C=C/C=C/1C]

(A)

See, e.g., McAlpine, J. B., et al., J. Antibiotics (1991) 44: 688; Schreiber, S. L., et al., J. Am. Chem. Soc. (1991) 113: 7433; U.S. Pat. No. 3,929,992. There are various numbering schemes proposed for rapamycin. To avoid confusion, when specific rapamycin analogs are named herein, the names are given with reference to rapamycin using the numbering scheme of formula A.

Rapamycin analogs useful in the invention are, for example, O-substituted analogs in which the hydroxyl group on the cyclohexyl ring of rapamycin is replaced by OR1 in which R1 is hydroxyalkyl, hydroxyalkoxyalkyl, acylaminoalkyl, or aminoalkyl; e.g. RAD001, also known as, everolimus as described in U.S. Pat. No. 5,665,772 and WO94/09010 the contents of which are incorporated by reference. Other suitable rapamycin analogs include those substituted at the 26- or 28-position. The rapamycin analog may be an epimer of an analog mentioned above, particularly an epimer of an analog substituted in position 40, 28 or 26, and may optionally be further hydrogenated, e.g. as described in U.S. Pat. No. 6,015,815, WO95/14023 and WO99/15530 the contents of which are incorporated by reference, e.g. ABT578 also known as zotarolimus or a rapamycin analog described in U.S. Pat. No. 7,091,213, WO98/02441 and WO01/14387 the contents of which are incorporated by reference, e.g. AP23573 also known as ridaforolimus.

Examples of rapamycin analogs suitable for use in the present invention from U.S. Pat. No. 5,665,772 include, but are not limited to, 40-O-benzyl-rapamycin, 40-O-(4'-hydroxymethyl)benzyl-rapamycin, 40-O-[4'-(1,2-dihydroxyethyl)]benzyl-rapamycin, 40-O-allyl-rapamycin, 40-O-[3'-(2,2-dimethyl-1,3-dioxolan-4(S)-yl)-prop-2'-en-1'-yl]-rapamycin, (2'E,4'S)-40-O-(4',5'-dihydroxypent-2'-en-1'-yl)-rapamycin, 40-O-(2-hydroxy)ethoxycarbonylmethyl-rapamycin, 40-O-(2-hydroxy)ethyl-rapamycin, 40-O-(3-hydroxy)propyl-rapamycin, 40-O-(6-hydroxy)hexyl-rapamycin, 40-O-[2-(2-hydroxy)ethoxy]ethyl-rapamycin, 40-O-[(3S)-2,2-dimethyldioxolan-3-yl]methyl-rapamycin, 40-O-[(2S)-2,3-dihydroxyprop-1-yl]-rapamycin, 40-O-(2- acetoxy)ethyl-rapamycin, 40-O-(2-nicotinoyloxy)ethyl-rapamycin, 40-O-[2-(N-morpholino)acetoxy]ethyl-rapamycin, 40-O-(2-N-imidazolylacetoxy)ethyl-rapamycin, 40-O-[2-(N-methyl-N'-piperazinyl)acetoxy]ethyl-rapamycin, 39-O-desmethyl-39,40-O,O-ethylene-rapamycin, (26R)-26-dihydro-40-O-(2-hydroxy)ethyl-rapamycin, 40-O-(2-aminoethyl)-rapamycin, 40-O-(2-acetaminoethyl)-rapamycin, 40-O-(2-nicotinamidoethyl)-rapamycin, 40-O-(2-(N-methyl-imidazo-2'-ylcarbethoxamido)ethyl)-rapamycin, 40-O-(2-ethoxycarbonylaminoethyl)-rapamycin, 40-O-(2-tolylsulfonamidoethyl)-rapamycin and 40-O-[2-(4',5'-dicarboethoxy-1',2',3'-triazol-1'-yl)-ethyl]-rapamycin.

Other rapamycin analogs useful in the present invention are analogs where the hydroxyl group on the cyclohexyl ring of rapamycin and/or the hydroxy group at the 28 position is replaced with an hydroxyester group are known, for example, rapamycin analogs found in U.S. RE44,768, e.g. temsirolimus.

Other rapamycin analogs useful in the preset invention include those wherein the methoxy group at the 16 position is replaced with another substituent, preferably (optionally hydroxy-substituted) alkynyloxy, benzyl, orthomethoxybenzyl or chlorobenzyl and/or wherein the methoxy group at the 39 position is deleted together with the 39 carbon so that the cyclohexyl ring of rapamycin becomes a cyclopentyl ring lacking the 39 position methyoxy group; e.g. as described in WO95/16691 and WO96/41807 the contents of which are incorporated by reference. The analogs can be further modified such that the hydroxy at the 40-position of rapamycin is alkylated and/or the 32-carbonyl is reduced.

Rapamycin analogs from WO95/16691 include, but are not limited to, 16-demethoxy-16-(pent-2-ynyl)oxy-rapamycin, 16-demethoxy-16-(but-2-ynyl)oxy-rapamycin, 16-demethoxy-16-(propargyl)oxy-rapamycin, 16-demethoxy-16-(4-hydroxy-but-2-ynyl)oxy-rapamycin, 16-demethoxy-16-benzyloxy-40-O-(2-hydroxyethyl)-rapamycin, 16-demethoxy-16-benzyloxy-rapamycin, 16-demethoxy-16-ortho-methoxybenzyl-rapamycin, 16-demethoxy-40-O-(2-methoxyethyl)-16-pent-2-ynyl)oxy-rapamycin, 39-demethoxy-40-desoxy-39-formyl-42-nor-rapamycin, 39-demethoxy-40-desoxy-39-hydroxymethyl-42-nor-rapamycin, 39-demethoxy-40-desoxy-39-carboxy-42-nor-rapamycin, 39-demethoxy-40-desoxy-39-(4-methyl-piperazin-1-yl)carbonyl-42-nor-rapamycin, 39-demethoxy-40-desoxy-39-(morpholin-4-yl)carbonyl-42-nor-rapamycin, 39-demethoxy-40-desoxy-39-[N-methyl, N-(2-pyridin-2-yl-ethyl)]carbamoyl-42-nor-rapamycin and 39-demethoxy-40-desoxy-39-(p-toluenesulfonylhydrazonomethyl)-42-nor-rapamycin.

Rapamycin analogs from WO96/41807 include, but are not limited to, 32-deoxo-rapamycin, 16-O-pent-2-ynyl-32-deoxo-rapamycin, 16-O-pent-2-ynyl-32-deoxo-40-O-(2-hydroxy-ethyl)-rapamycin, 16-O-pent-2-ynyl-32-(S)-dihydro-40-O-(2-hydroxyethyl)-rapamycin, 32(S)-dihydro-40-O-(2-methoxy)ethyl-rapamycin and 32(S)-dihydro-40-O-(2-hydroxyethyl)-rapamycin.

Another suitable rapamycin analog is umirolimus as described in US2005/0101624 the contents of which are incorporated by reference.

RAD001, otherwise known as everolimus (Afinitor®), has the chemical name (1R,9S,12S,15R,16E,18R,19R,21R,23S,24E,26E,28E,30S,32S,35R)-1,18-dihydroxy-12-{(1R)-2-[(1S,3R,4R)-4-(2-hydroxyethoxy)-3-methoxycyclohexyl]-1-methylethyl}-19,30-dimethoxy-15,17,21,23,29,35-hexamethyl-11,36-dioxa-4-aza-tricyclo[30.3.1.04,9]hexatriaconta-16,24,26,28-tetraene-2,3,10,14,20-pentaone Further examples of allosteric mTOR inhibitors include sirolimus (rapamycin, AY-22989), 40-[3-hydroxy-2-(hydroxymethyl)-2-methylpropanoate]-rapamycin (also called temsirolimus or CCI-779) and ridaforolimus (AP-23573/MK-8669). Other examples of allosteric mTor inhibitors include zotarolimus (ABT578) and umirolimus.

Alternatively or additionally, catalytic, ATP-competitive mTOR inhibitors have been found to target the mTOR kinase domain directly and target both mTORC1 and mTORC2. These are also more effective inhibitors of mTORC1 than such allosteric mTOR inhibitors as rapamycin, because they modulate rapamycin-resistant mTORC1 outputs such as 4EBP1-T37/46 phosphorylation and cap-dependent translation.

Catalytic inhibitors include: BEZ235 or 2-methyl-2-[4-(3-methyl-2-oxo-8-quinolin-3-yl-2,3-dihydro-imidazo[4,5-c]quinolin-1-yl)-phenyl]-propionitrile, or the monotosylate salt form. the synthesis of BEZ235 is described in WO2006/122806; CCG168 (otherwise known as AZD-8055, Chresta, C. M., et al., Cancer Res, 2010, 70(1), 288-298) which has the chemical name {5-[2,4-bis-((S)-3-methyl-morpholin-4-yl)-pyrido[2,3d]pyrimidin-7-yl]-2-methoxy-phenyl}-methanol; 3-[2,4-bis[(3S)-3-methylmorpholin-4-yl]pyrido[2,3-d]pyrimidin-7-yl]-N-methylbenzamide (WO09104019); 3-(2-aminobenzo[d]oxazol-5-yl)-1-isopropyl-1H-pyrazolo[3,4-d]pyrimidin-4-amine (WO10051043 and WO2013023184); A N-(3-(N-(3-((3,5-dimethoxyphenyl)amino)quinoxaline-2-yl) sulfamoyl)phenyl)-3-methoxy-4-methylbenzamide (WO07044729 and WO12006552); PKI-587 (Venkatesan, A. M., J. Med. Chem., 2010, 53, 2636-2645) which has the chemical name 1-[4-[4-(dimethylamino)piperidine-1-carbonyl]phenyl]-3-[4-(4,6-dimorpholino-1,3,5-triazin-2-yl)phenyl]urea; GSK-2126458 (ACS Med. Chem. Lett., 2010, 1, 39-43) which has the chemical name 2,4-difluoro-N-{2-methoxy-5-[4-(4-pyridazinyl)-6-quinolinyl]-3-pyridinyl}benzenesulfonamide; 5-(9-isopropyl-8-methyl-2-morpholino-9H-purin-6-yl)pyrimidin-2-amine (WO10114484); (E)-N-(8-(6-amino-5-(trifluoromethyl)pyridin-3-yl)-1-(6-(2-cyanopropan-2-yl)pyridin-3-yl)-3-methyl-1H-imidazo[4,5-c]quinolin-2(3H)-ylidene)cyanamide (WO12007926).

Further examples of catalytic mTOR inhibitors include 8-(6-methoxy-pyridin-3-yl)-3-methyl-1-(4-piperazin-1-yl-3-trifluoromethyl-phenyl)-1,3-dihydro-imidazo[4,5-c]quinolin-2-one (WO2006/122806) and Ku-0063794 (Garcia-Martinez J M, et al., Biochem J., 2009, 421(1), 29-42. Ku-0063794 is a specific inhibitor of the mammalian target of rapamycin (mTOR).) WYE-354 is another example of a catalytic mTor inhibitor (Yu K, et al. (2009). Biochemical, Cellular, and In vivo Activity of Novel ATP-Competitive and Selective Inhibitors of the Mammalian Target of Rapamycin. Cancer Res. 69(15): 6232-6240).

mTOR inhibitors useful according to the present invention also include prodrugs, derivatives, pharmaceutically acceptable salts, or analogs thereof of any of the foregoing.

mTOR inhibitors, such as RAD001, may be formulated for delivery based on well-established methods in the art based on the particular dosages described herein. In particular, U.S. Pat. No. 6,004,973 (incorporated herein by reference) provides examples of formulations useable with the mTOR inhibitors described herein.

Pharmaceutical Compositions and Treatments

Pharmaceutical compositions of the present invention may comprise a CAR-expressing cell, e.g., a plurality of CAR-expressing cells, as described herein, in combination with one or more pharmaceutically or physiologically acceptable carriers, diluents or excipients. Such compositions may comprise buffers such as neutral buffered saline, phosphate buffered saline and the like; carbohydrates such as glucose, mannose, sucrose or dextrans, mannitol; proteins; polypeptides or amino acids such as glycine; antioxidants; chelating agents such as EDTA or glutathione; adjuvants (e.g., aluminum hydroxide); and preservatives. Compositions of the present invention are in one aspect formulated for intravenous administration.

Pharmaceutical compositions of the present invention may be administered in a manner appropriate to the disease to be treated (or prevented). The quantity and frequency of administration will be determined by such factors as the condition of the patient, and the type and severity of the patient's disease, although appropriate dosages may be determined by clinical trials.

In one embodiment, the pharmaceutical composition is substantially free of, e.g., there are no detectable levels of a contaminant, e.g., selected from the group consisting of endotoxin, mycoplasma, replication competent lentivirus (RCL), p24, VSV-G nucleic acid, HIV gag, residual anti-CD3/anti-CD28 coated beads, mouse antibodies, pooled human serum, bovine serum albumin, bovine serum, culture media components, vector packaging cell or plasmid components, a bacterium and a fungus. In one embodiment, the bacterium is at least one selected from the group consisting of *Alcaligenes faecalis, Candida albicans, Escherichia coli, Haemophilus influenza, Neisseria meningitides, Pseudomonas aeruginosa, Staphylococcus aureus, Streptococcus pneumonia*, and *Streptococcus pyogenes* group A.

When "an immunologically effective amount", "an anti-tumor effective amount", "an tumor-inhibiting effective amount", or "therapeutic amount" is indicated, the precise amount of the compositions of the present invention to be administered can be determined by a physician with consideration of individual differences in age, weight, tumor size, extent of infection or metastasis, and condition of the patient (subject). It can generally be stated that a pharmaceutical composition comprising the T cells described herein may be administered at a dosage of $10^4$ to $10^9$ cells/kg body weight, preferably $10^5$ to $10^6$ cells/kg body weight, including all integer values within those ranges. T cell compositions may also be administered multiple times at these dosages. The cells can be administered by using infusion techniques that are commonly known in immunotherapy (see, e.g., Rosenberg et al., New Eng. J. of Med. 319:1676, 1988). The optimal dosage and treatment regime for a particular patient can readily be determined by one skilled in the art of medicine by monitoring the patient for signs of disease and adjusting the treatment accordingly.

In some embodiments, a dose of CAR cells (e.g., NKR-CAR cells, e.g., KIR-CAR cells) comprises about $1\times10^6$, $1.1\times10^6$, $2\times10^6$, $3.6\times10^6$, $5\times10^6$, $1\times10^7$, $1.8\times10^7$, $2\times10^7$, $5\times10^7$, $1\times10^8$, $2\times10^8$, or $5\times10^8$ cells/kg. In some embodiments, a dose of CAR cells (e.g., NKR-CAR cells, e.g., KIR-CAR cells) comprises at least about $1\times10^6$, $1.1\times10^6$, $2\times10^6$, $3.6\times10^6$, $5\times10^6$, $1\times10^7$, $1.8\times10^7$, $2\times10^7$, $5\times10^7$, $1\times10^8$, $2\times10^8$, or $5\times10^8$ cells/kg. In some embodiments, a dose of CAR cells (e e.g., NKR-CAR cells, e.g., KIR-CAR cells) comprises up to about $1\times10^6$, $1.1\times10^6$, $2\times10^6$, $3.6\times10^6$, $5\times10^6$, $1\times10^7$, $1.8\times10^7$, $2\times10^7$, $5\times10^7$, $1\times10^8$, $2\times10^8$, or $5\times10^8$ cells/kg. In some embodiments, a dose of CAR cells (e.g., NKR-CAR cells, e.g., KIR-CAR cells) comprises about $1.1\times10^6$-$1.8\times10^7$ cells/kg. In some embodiments, a dose of CAR cells (e.g., NKR-CAR cells, e.g., KIR-CAR cells) comprises about $1\times10^7$, $2\times10^7$, $5\times10^7$, $1\times10^8$, $2\times10^8$, $5\times10^8$, $1\times10^9$, $2\times10^9$, or $5\times10^9$ cells. In some embodiments, a dose of CAR cells (e.g., NKR-CAR cells, e.g., KIR-CAR cells) comprises at least about $1\times10^7$, $2\times10^7$, $5\times10^7$, $1\times10^8$, $2\times10^8$, $5\times10^8$, $1\times10^9$, $2\times10^9$, or $5\times10^9$ cells. In some embodiments, a dose of CAR cells (e.g., NKR-CAR cells, e.g., KIR-CAR cells) comprises up to about $1\times10^7$, $2\times10^7$, $5\times10^7$, $1\times10^8$, $2\times10^8$, $5\times10^8$, $1\times10^9$, $2\times10^9$, or $5\times10^9$ cells.

The cells can be administered by using infusion techniques that are commonly known in immunotherapy (see, e.g., Rosenberg et al., New Eng. J. of Med. 319:1676, 1988).

In certain embodiments, it may be desired to administer activated CAR-expressing cells to a subject and then subsequently redraw blood (or have an apheresis performed), activate the cells therefrom according to the present invention, and reinfuse the patient with these activated and expanded cells. This process can be carried out multiple times every few weeks. In certain embodiments, T cells can be activated from blood draws of from 10 cc to 400 cc. In certain embodiments, T cells are activated from blood draws of 20 cc, 30 cc, 40 cc, 50 cc, 60 cc, 70 cc, 80 cc, 90 cc, or 100 cc. Not to be bound by theory, using this multiple blood draw/multiple reinfusion protocol may serve to select out certain populations of T cells.

The administration of the subject compositions may be carried out in any convenient manner, including by aerosol inhalation, injection, ingestion, transfusion, implantation or transplantation. The compositions described herein may be administered to a patient subcutaneously, intradermally, intratumorally, intranodally, intramedullary, intramuscularly, by intravenous (i.v.) injection, or intraperitoneally. In one embodiment, the CAR-expressing cell (e.g., T cell or NK cell) compositions of the present invention are administered to a patient by intradermal or subcutaneous injection. In another embodiment, the CAR-expressing cell (e.g., T cell or NK cell) compositions of the present invention are preferably administered by i.v. injection. The compositions of CAR-expressing cell (e.g., T cell or NK cell) may be injected directly into a tumor, lymph node, or site of infection.

In certain embodiments of the present invention, cells activated and expanded using the methods described herein, or other methods known in the art where T cells are expanded to therapeutic levels, are administered to a patient in conjunction with (e.g., before, simultaneously or following) any number of relevant treatment modalities, including but not limited to treatment with agents such as antiviral therapy, cidofovir and interleukin-2, Cytarabine (also known as ARA-C) or natalizumab treatment for MS patients or efalizumab treatment for psoriasis patients or other treatments for PML patients. In further embodiments, the T cells of the invention may be used in combination with chemotherapy, radiation, immunosuppressive agents, such as cyclosporin, azathioprine, methotrexate, mycophenolate, and FK506, antibodies, or other immunoablative agents such as CAM PATH, anti-CD3 antibodies or other antibody therapies, cytoxin, fludaribine, cyclosporin, FK506, rapamycin, mycophenolic acid, steroids, FR901228, cytokines, and irradiation. These drugs inhibit either the calcium dependent phosphatase calcineurin (cyclosporine and FK506) or inhibit the p70S6 kinase that is important for growth factor induced signaling (rapamycin) (Liu et al., Cell 66:807-815, 1991; Henderson et al., Immun. 73:316-321, 1991; Bierer et al., Curr. Opin. Immun. 5:763-773, 1993). In a further embodiment, the cell compositions of the present invention are administered to a patient in conjunction with (e.g., before, simultaneously or following) bone marrow transplantation, T cell ablative therapy using either chemotherapy agents such as, fludarabine, external-beam radiation therapy (XRT), cyclophosphamide, or antibodies such as OKT3 or CAM- PATH. In another embodiment, the cell compositions of the present invention are administered following B-cell ablative therapy such as agents that react with CD20, e.g., Rituxan. For example, in one embodiment, subjects may undergo standard treatment with high dose chemotherapy followed by peripheral blood stem cell transplantation. In certain embodiments, following the transplant, subjects receive an infusion of the expanded immune cells of the present invention. In an additional embodiment, expanded cells are administered before or following surgery.

In a particular exemplary aspect, subjects may undergo leukapheresis, wherein leukocytes are collected, enriched, or depleted ex vivo to select and/or isolate the cells of interest, e.g., immune effector cells (e.g., T cells or NK cells). These immune effector cell (e.g., T cell or NK cell) isolates may be expanded by methods known in the art and treated such that one or more CAR constructs of the invention may be introduced, thereby creating a CAR-expressing cell (e.g., CAR T cell or CAR-expressing NK cell) of the invention. Subjects in need thereof may subsequently undergo standard treatment with high dose chemotherapy followed by peripheral blood stem cell transplantation. In certain aspects, following or concurrent with the transplant, subjects receive an infusion of the expanded CAR-expressing cell (e.g., CAR T cell or CAR-expressing NK cell) of the present invention. In an additional aspect, expanded cells are administered before or following surgery.

The dosage of the above treatments to be administered to a patient will vary with the precise nature of the condition being treated and the recipient of the treatment. The scaling of dosages for human administration can be performed according to art-accepted practices. Strategies for CAR T cell dosing and scheduling have been discussed (Ertl et al, 2011, Cancer Res, 71:3175-81; Junghans, 2010, Journal of Translational Medicine, 8:55).

In one embodiment, the CAR is introduced into immune effector cells (e.g., T cells or NK cells), e.g., using in vitro transcription, and the subject (e.g., human) receives an initial administration of a CAR-expressing cell (e.g., CAR T cell or CAR-expressing NK cell) of the invention, and one or more subsequent administrations of the CAR-expressing cell (e.g., CAR T cell or CAR-expressing NK cell) of the invention, wherein the one or more subsequent administrations are administered less than 15 days, e.g., 14, 13, 12, 11, 10, 9, 8, 7, 6, 5, 4, 3, or 2 days after the previous administration. In one embodiment, more than one administration of the CAR-expressing cell (e.g., CAR T cell or CAR-expressing NK cell) of the invention are administered to the subject (e.g., human) per week, e.g., 2, 3, or 4 administrations of the CAR-expressing cell (e.g., CAR T cell or CAR-expressing NK cell) of the invention are administered per week. In one embodiment, the subject (e.g., human subject) receives more than one administration of the CAR-expressing cell (e.g., CAR T cell or CAR-expressing NK cell) per week (e.g., 2, 3 or 4 administrations per week) (also referred to herein as a cycle), followed by a week of no CAR-expressing cell (e.g., CAR T cell or CAR-expressing NK cell) administrations, and then one or more additional administration of the CAR-expressing cell (e.g., CAR T cell or CAR-expressing NK cell) (e.g., more than one administration of the CAR-expressing cell (e.g., CAR T cell or CAR-expressing NK cell) per week) is administered to the subject. In another embodiment, the subject (e.g., human subject) receives more than one cycle of CAR-expressing cell (e.g., CAR T cell or CAR-expressing NK cell), and the time between each cycle is less than 10, 9, 8, 7, 6, 5, 4, or 3 days. In one embodiment, the CAR-expressing cell (e.g., CAR T cell or CAR-expressing NK cell) are administered every other day for 3 administrations per week. In one embodiment, the CAR-expressing cell (e.g., CAR T cell or CAR-expressing NK cell) of the invention are administered for at least two, three, four, five, six, seven, eight or more weeks.

In one aspect, CD123 CAR-expressing cell (e.g., CAR T cell or CAR-expressing NK cell) are generated using lentiviral viral vectors, such as lentivirus. CAR-expressing cell (e.g., CAR T cell or CAR-expressing NK cell) generated that way will have stable CAR expression.

In one aspect, CAR-expressing cells, e.g., CARTs or CAR-expressing NK cells, are generated using a viral vector such as a gammaretroviral vector, e.g., a gammaretroviral vector described herein. CAR-expressing cells, e.g., CARTs or CAR-expressing NK cells, generated using these vectors can have stable CAR expression.

In one aspect, the CAR-expressing cell (e.g., CAR T cell or CAR-expressing NK cell) transiently express CAR vectors for 4, 5, 6, 7, 8, 9, 10, 11, 12, 13, 14, 15 days after transduction. Transient expression of CARs can be effected by RNA CAR vector delivery. In one aspect, the CAR RNA is transduced into the cell (e.g., T cell or NK cell) by electroporation.

A potential issue that can arise in patients being treated using transiently expressing CAR cell (e.g., CAR T cell or CAR-expressing NK cell) (particularly with murine scFv bearing CARs) is anaphylaxis after multiple treatments.

Without being bound by this theory, it is believed that such an anaphylactic response might be caused by a patient developing humoral anti-CAR response, i.e., anti-CAR antibodies having an anti-IgE isotype. It is thought that a patient's antibody producing cells undergo a class switch from IgG isotype (that does not cause anaphylaxis) to IgE isotype when there is a ten to fourteen day break in exposure to antigen.

If a patient is at high risk of generating an anti-CAR antibody response during the course of transient CAR therapy (such as those generated by RNA transductions), CAR-expressing cell (e.g., CAR T cell or CAR-expressing NK cell) infusion breaks should not last more than ten to fourteen days.

EXPERIMENTAL EXAMPLES

The invention is further described in detail by reference to the following experimental examples. These examples are provided for purposes of illustration only, and are not intended to be limiting unless otherwise specified. Thus, the invention should in no way be construed as being limited to the following examples, but rather, should be construed to encompass any and all variations which become evident as a result of the teaching provided herein.

Without further description, it is believed that one of ordinary skill in the art can, using the preceding description and the following illustrative examples, make and utilize the compounds of the present invention and practice the claimed methods. The following working examples therefore, specifically point out the preferred embodiments of the present invention, and are not to be construed as limiting in any way the remainder of the disclosure.

Example 1: Chimeric NK Receptors

The results presented herein demonstrate an alternative approach to constructing CARs for T cells that can be more finely regulated compared with current CAR designs. Experiments were designed to develop a novel, regulated CAR system that comprises at least two or three chimeric fusion proteins. The primary T cell activating signal and inhibitory signals are based upon naturally occurring activating and inhibitory receptors of NK cells known as killer cell immunoglobulin-like receptors (KIRs).

KIRs exist as both activating and inhibitory forms that depend upon the intracellular domain of the receptor. Activating KIRs deliver their signals through an interaction with the immunotyrosine-based activation motif (ITAM) containing membrane protein, DAP12 that is recruited by residues within the transmembrane domains of these proteins. Inhibitory KIRs bear a cytoplasmic domain that contains immunotyrosine-based inhibitory motifs (ITIMs), which abrogate the activating signal leading to inhibition of NK cytolytic and cytokine producing activity. Similar to TCRs, KIRs belong to the immunoglobulin family of protein receptors, and many bind to invariant MHC and MHC-like ligands. Without wishing to be bound by any particular theory, it is believed that these interactions are utilized to naturally distinguish normal cells (usually expressing high density MHC class I) from malignant or virally infected cells (often with low or missing MHC class I).

KIR-like chimeric antigen receptors (KIR-CARs) have been constructed which fuse an scfv to a target antigen of interest with activating and inhibitory KIRs as shown in FIG. 1. Conditional activation of T cells is generated by engagement of an activating KIR-CAR (actKIR-CAR) or standard TCR-zeta CAR bearing an scfv to an antigen on the malignant cell of interest. An inhibitory CAR (inhCAR) bearing an scfv directed against an antigen that is present on normal, but not malignant tissue would provide dampening of the activating CAR primary signal when the T cell encounters normal cells. Examples of antigens that serve as useful targets for inhibitory CARs include the ephrin receptors (Pasquale, 2010, Nat Rev Cancer 10(3):165-80) and claudins (Singh et al., 2010, J Oncol, 2010:541957), which are expressed by epithelial cells from normal tissues, but often selectively lost by cancers (e.g. EPHA7).

Example 2: Activating KIR-CAR Construction and Activity

Figure 2:
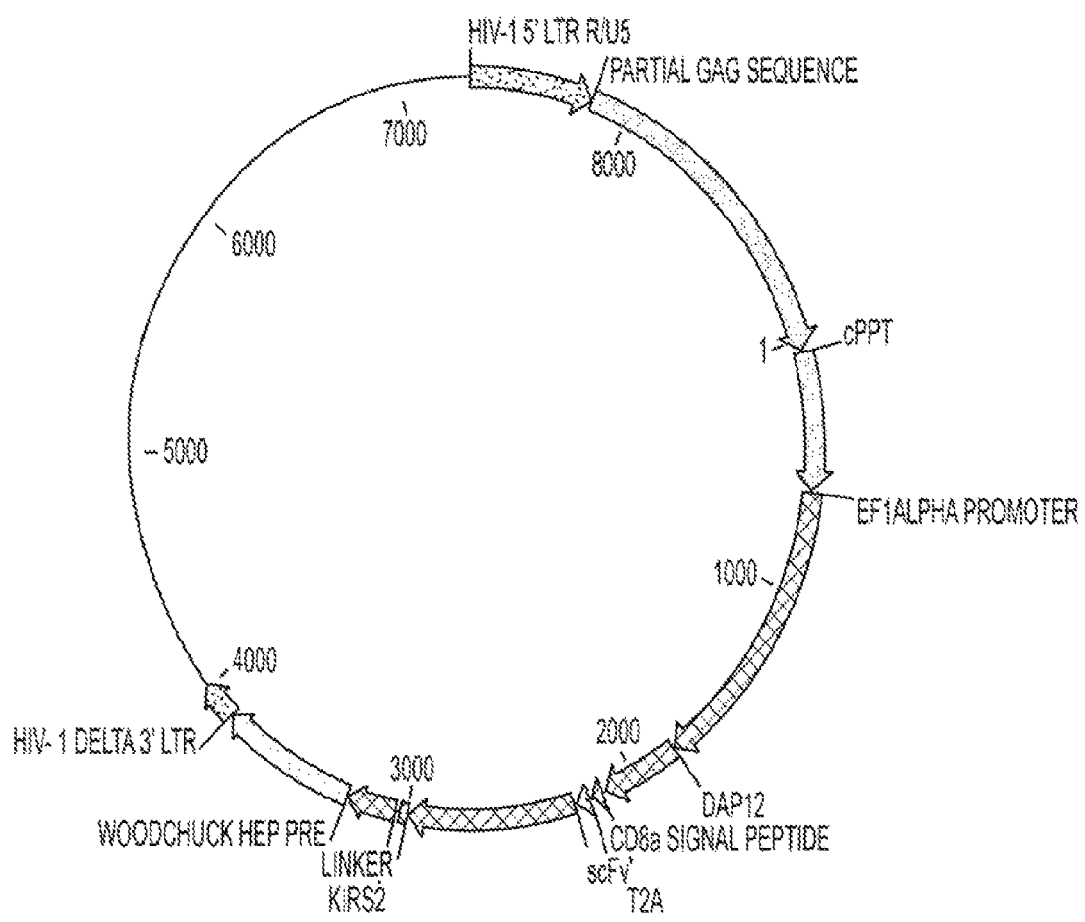
FIG. 2 is a schematic representation of the lentiviral vector used to deliver an activating KIR-based CAR in combination with the DAP12 signaling molecule.
Figure 3:
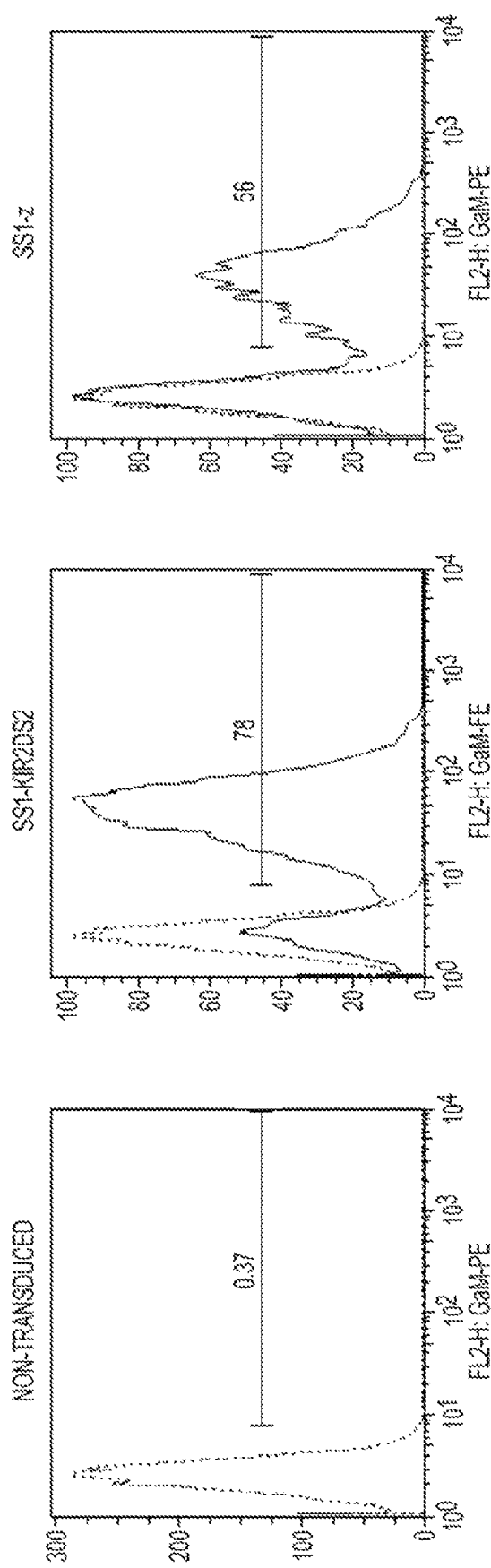
FIG. 3 is an image demonstrating that a mesothelin-specific actKIR-CARs can be efficiently expressed on the surface of primary human T cells. Human T cells were stimulated with anti-CD3/anti-CD28 microbeads and transduced with the indicated CAR or mock transduced and expanded ex vivo. The expression was detected using a biotinylated goat-anti-mouse F(ab)2-specific polyclonal IgG (Jackson Immunologics) followed by staining with streptavidin-PE.
Figure 4:
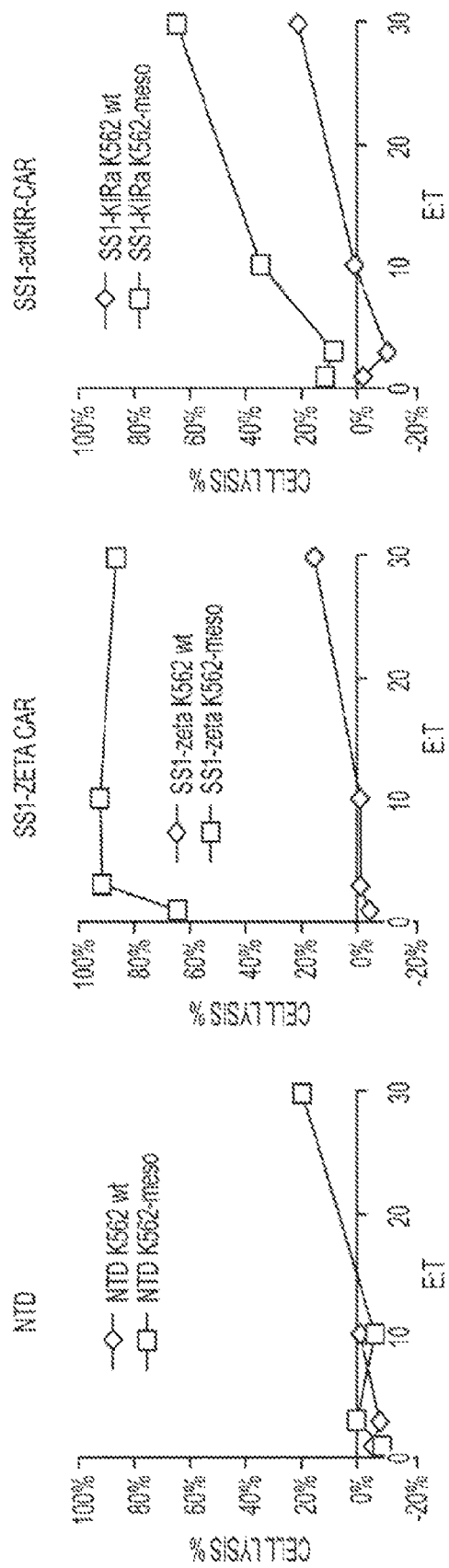
FIG. 4 demonstrates that T cells expressing the SS1 actKIR-CAR exhibited cytotoxic activity towards target K562 cells engineered to express the mesothelin ligand (KT-meso). Human T cells were stimulated with anti-CD3/anti-CD28 microbeads, transduced with the indicated CAR or mock transduced and expanded ex vivo. $10^5$ CFSE-labeled K562 cells expressing mesothelin (KT-meso) or wild-type control K562 were incubated with varying ratios of CAR-expressing T cells for 16 hours at 37° C., 5% $CO_2$. The K562 target cells were then enumerated by flow cytometry using countbright beads and a viability stain (7AAD). The percentage of K562 cells lysed (percent lysis) was calculated by subtracting the number of viable target cells remaining after incubation with effector T cells from the number of viable K562 remaining after overnight culture without effector T cells, and then dividing by the number of viable K562 remaining after overnight culture without effector T cells.

Experiments were designed to construct activating KIR-CARs based upon fusion of the anti-CD19 or anti-mesothelin scFv (SS-1) that were previously incorporated into CARs based upon the TCR-zeta cytoplasmic domain that are currently in clinical trials. The human KIR2DS2 activating KIR receptor was chosen as the initial base receptor for the actKIR-CAR. In order to deliver activating signals, the actKIR-CARs required coexpression of DAP12, which is not expressed normally in T cells. Therefore, a lentiviral vector that expresses both the actKIR-CAR with human DAP12 using a "bicistronic" gene cassette based upon the 2A ribosomal skip peptide was constructed. A diagram of the lentiviral vector is illustrated in FIG. 2. Initial studies demonstrated that the actKIR-CARs were efficiently expressed in primary human T cells and the SS1 actKIR-CAR bound to mesothelin (FIG. 3). Similar to the previously developed and published SS1 scFv CD3 zeta (SS1-ζ) CAR (Carpenito et al., 2009, Proc Natl Acad Sci USA 106(9): 3360-5), T cells expressing the SS1 actKIR-CAR demonstrated cytotoxic activity towards target K562 cells engineered to express the mesothelin ligand (KT-meso) as shown in FIG. 4. Neither receptor exhibits killing of wild-type K562 lacking the mesothelin target.

Figure 5:
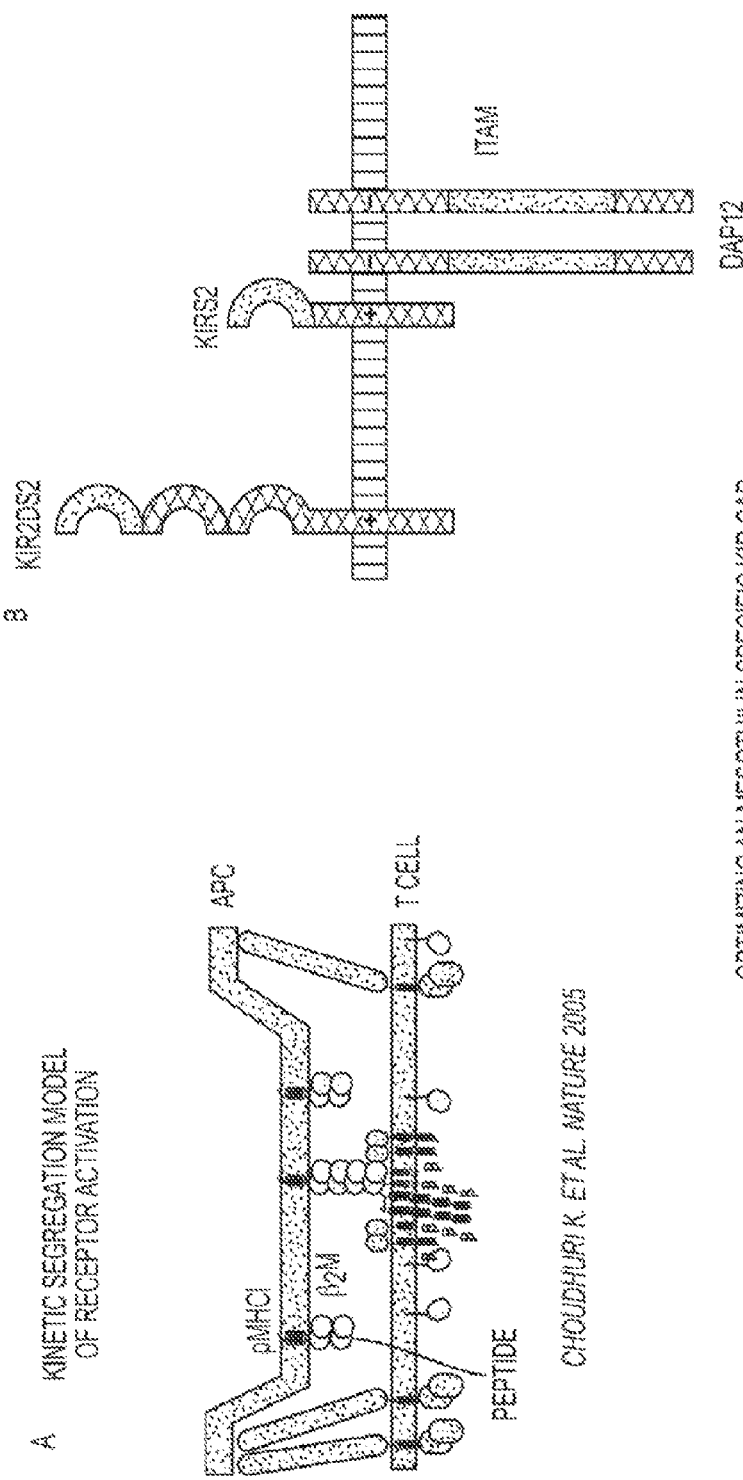
FIG. 5, comprising
Figure 6:
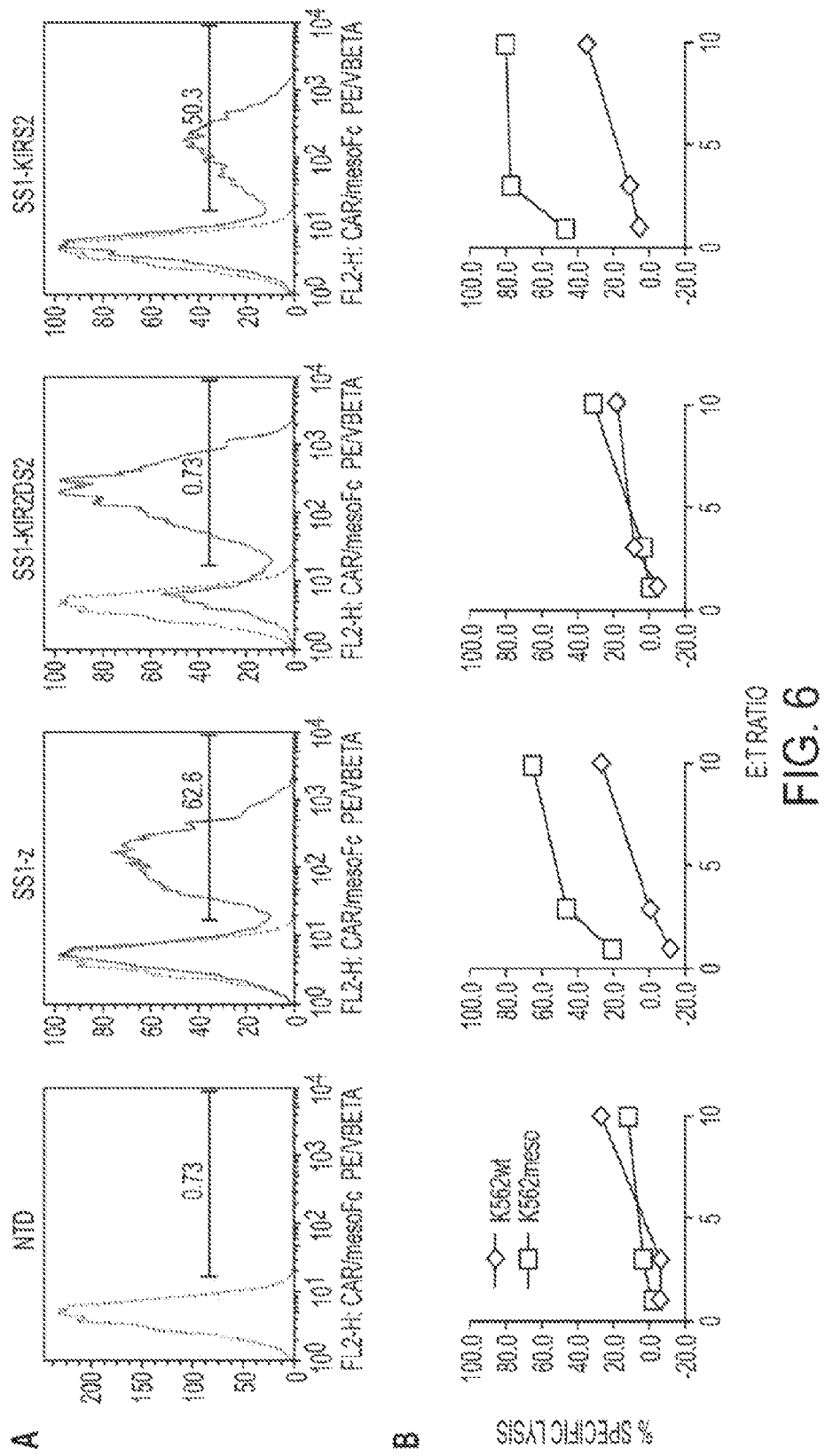
FIG. 6, comprising

Since the cytotoxic activity of the SS1 KIR CAR towards mesothelin-positive target cells was lower than the standard TCRzeta-based CAR targeting the same antigen with comparable CAR surface expression, it is believed that the mesothelin CAR may have an extracellular hinge (based upon wild-type KIR2DS2) that is non-optimal for segregation from CD45 due to its length. The kinetic segregation of activating ITAM-based receptors from CD45 is believed to be a key mechanisms for TCR activation, and dependent upon a length scale between the T cell and target cell membranes of ~14-15 nm (Choudhuri et al., 2005, Nature 436(7050):578-82). It is estimated that the KIR2DS2 based SS1 KIR-CAR to have a length scale of greater than 20 nm based upon the partial crystal structure of mesothelin demonstrating that the SS1 epitope is likely at an ~10 nm distance from the target cell membrane (Ma et al., 2012, J Biol Chem 287(40):33123-31) and CAR that is estimated to be ~10 nm assuming each Ig-like domain is ~3.5 nm in the KIR2DS2 hinge in addition to the scFv. Therefore an activating KIR CAR in which the KIR2DS2 hinge was removed (KIRS2 CAR) as shown schematically in FIG. 5 was constructed. It was shown that an SS1 scFv based KIRS2 CAR exhibited enhanced cytolytic activity towards mesothelin-expressing target cells compared with the CAR formed by fusion of the SS1 scFv onto full length wildtype KIR2DS2 (FIG. 6). This optimized KIRS2 CAR also showed enhanced activity over the SS1 scFv based TCRzeta CAR having a CD8 alpha extracellular hinge.

Example 3: InhKIR-CAR Construction and Activity

Figure 7:
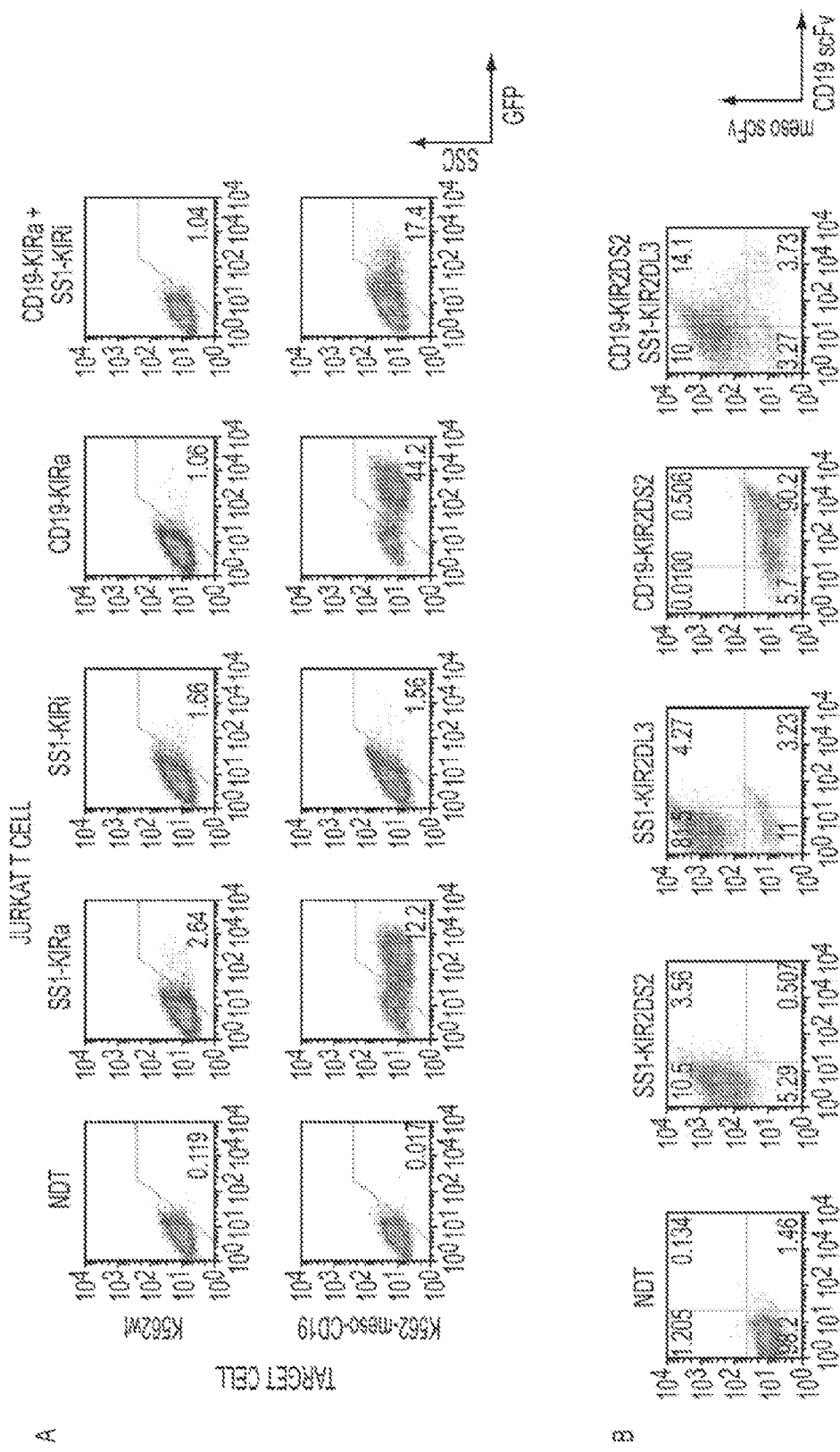
FIG. 7, comprising

An inhibitory KIR-CAR was constructed based upon the fusion of the anti-mesothelin SS1 scFv to the inhibitory KIR2DL3 receptor base. Initial studies demonstrated that the inhKIR-CARs efficiently expressed in primary human T cells. CD19 actKIR-CAR, SS1 actKIR-CAR and SS1 inhKIR-CAR alone or in combination have been introduced into Jurkat T cells bearing a dsGFP reporter under the control of an NFAT-driven promoter to monitor activation of this critical T cell signaling pathway. While Jurkat T cells expressing CD19 actKIR-CAR or SS1 actKIR-CAR alone are efficiently activated by K562 expressing both CD19 and mesothelin (KT-meso/CD19), Jurkat T cells co-expressing the CD19 actKIR-CAR and the SS1 inhKIR-CAR showed markedly reduced activation by the same KT-meso/CD19 target cells (FIG. 7A); however, analysis of the surface expression of the CD19 and mesothelin scFv binding using idiotype specific reagents surprisingly demonstrated that the expression of the different scFv target specificities were mutually exclusive (FIG. 7B).

Figure 8:
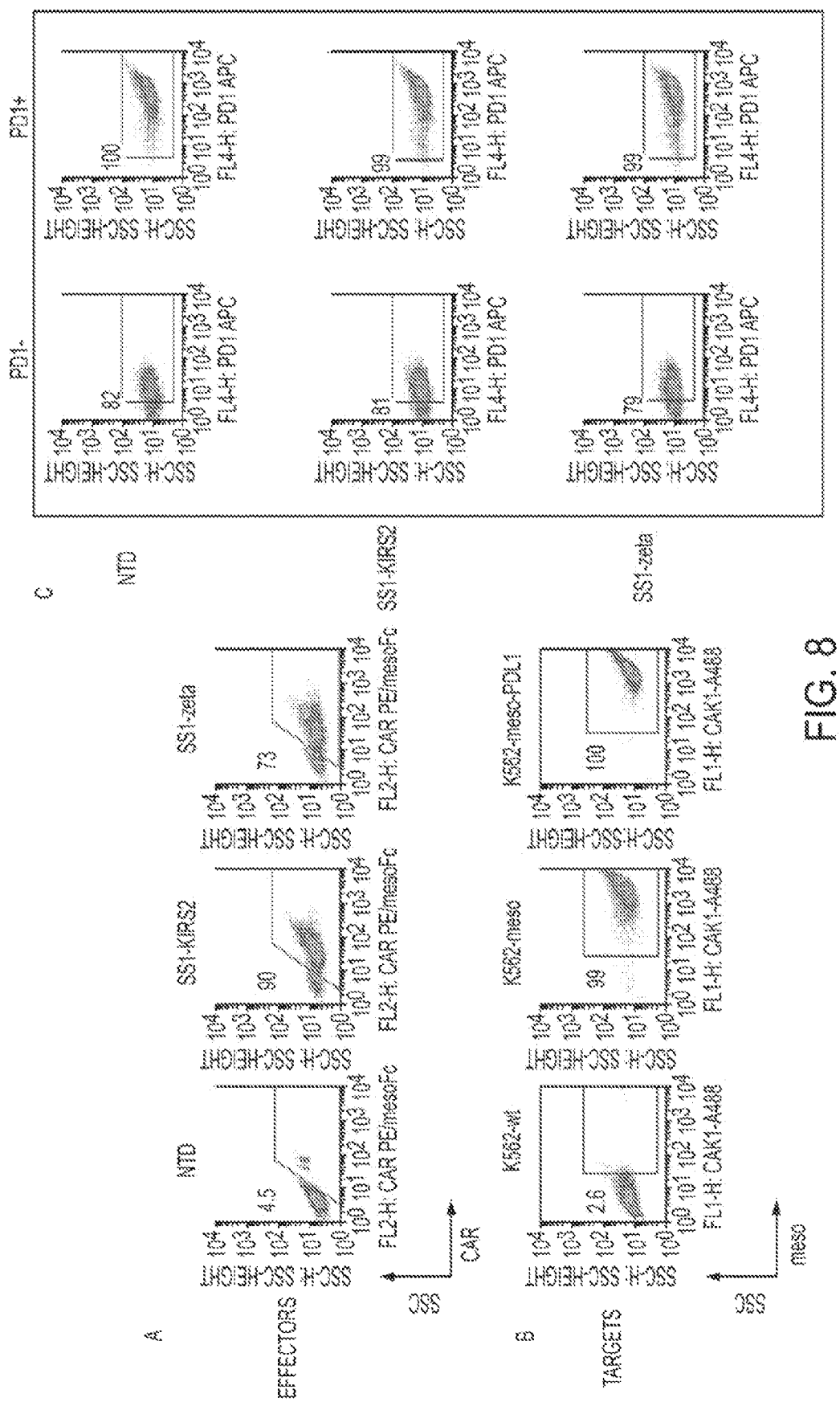
FIG. 8, comprising
Figure 9:
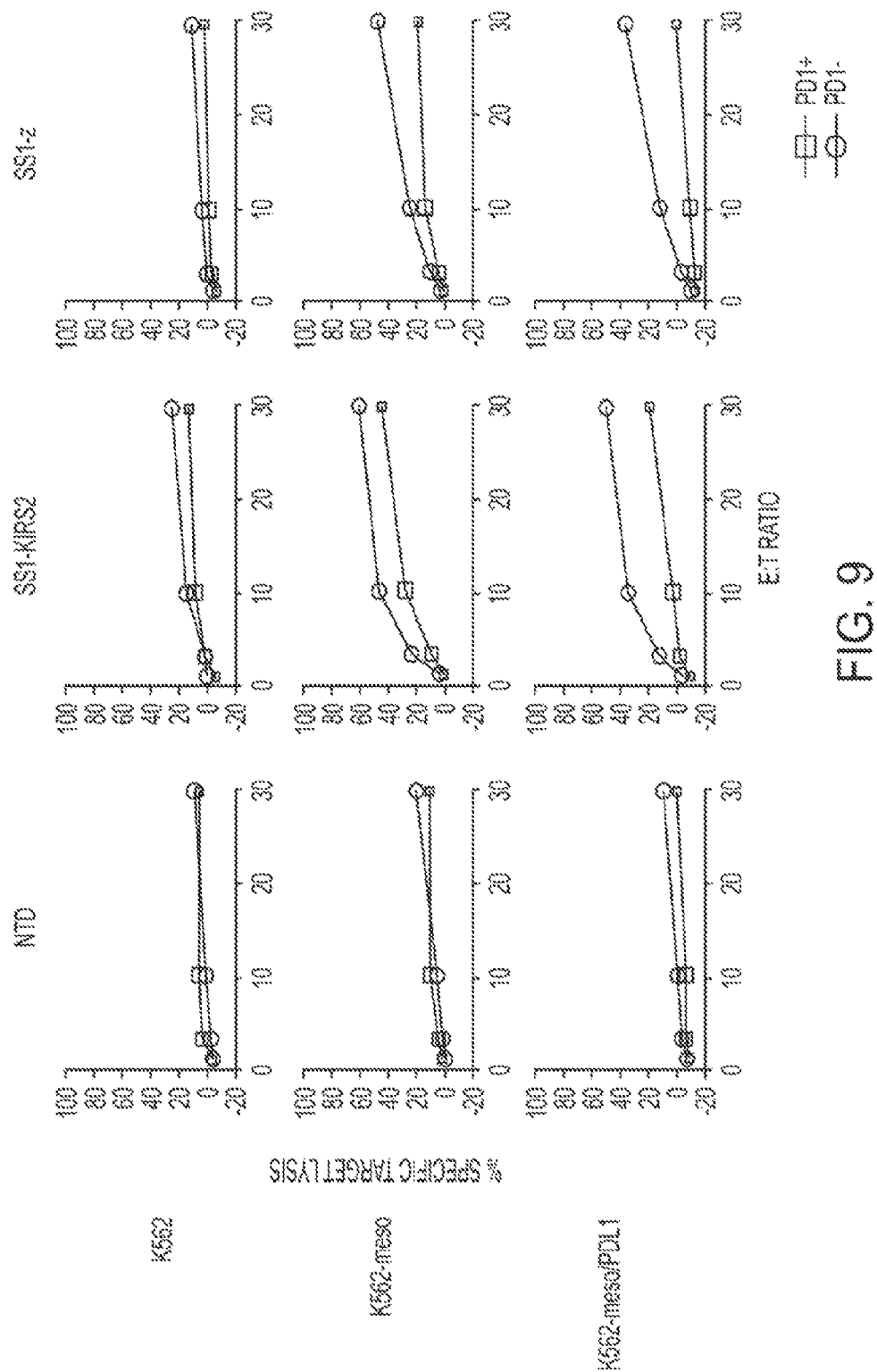
FIG. 9 is an image demonstrating that the combination of co-expressing wild-type PD-1 with both an activating KIR-based CAR and TCR-zeta based CAR targeting mesothelin led to PD-1 ligand 1 (PDL-1) dependent inhibition of the mesothelin-specific activating KIR-CAR cytotoxicity. Primary human T cells were stimulated with CD3/28 microbeads followed by lentiviral transduction with either the SS1-KIRS2 activating KIR CAR, the SS1-zeta CAR or mock transduced (NTD). The T cells were expanded over 9 days followed by electroporation of $5\times10^6$ T cells with 10 ug of in vitro transcribed RNA encoding wild-type PD1 using a BTX ECM830 electroporator (PD1+) or mock transfected (PD1−). The surface expression of the SS1-specific CAR and PD-1 was determined as shown in FIG. 8. K562 target cells with either no mesothelin or expressing mesothelin with or without PDL-1 were mixed with the different T cells conditions as indicated using varying effector T cell to target ratios of 30:1 to 1:1 as shown. Target K562 cell lysis was assessed using a calcein AM dye method to quantify the remaining viable cells following 4 hours of incubation. Data shown is calculated % target cell lysis compared against target cells without effector cells.
Figure 19:
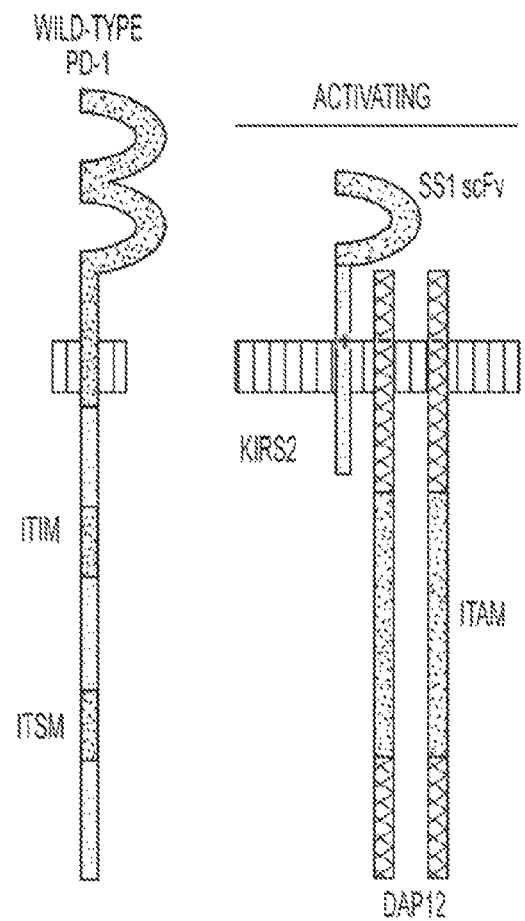
FIG. 19 shows a schematic representation of the receptors used in Experiments shown in FIGS. 21-23.

Example 4: Sensitivity of Activating KIR-CAR Designs to Natural Inhibitory Receptor Systems Since co-expression of two scFv CARs is limited, a strategy was pursued to evaluate the sensitivity of the KIR-based activating CARs to inhibitory signals derived from the PD-1 receptor. PD-1 is a natural receptor in T cells that uses an ITIM in the cytoplasmic domain similar to inhibitory KIRs to recruit phosphatases that negatively regulate TCR signaling. A schematic representation is shown in FIG. 19. The results presented herein demonstrate that wild-type PD-1 can be over-expressed with both an activating KIR-based CAR and a TCR-zeta based CAR targeting mesothelin (FIGS. 8A and 8C). The results also show that this combination led to PD-1 ligand 1 (PDL-1) dependent inhibition of the mesothelin-specific activating KIR-CAR cytotoxicity (FIG. 9). In the context of normal PD-1 expression by the T cells (i.e. T cells without PD-1 transfection), the KIR-CAR exhibits less inhibition when encountering PD-L1 overexpressing target cells compared with the TCR-zeta based CAR. Without wishing to be bound by any particular theory, it is believed that this may be an advantage of the KIR-CARs when encountering tumors that commonly express inhibitory receptor ligands.

Example 5: Co-Stimulation Dependent Activation of KIR CARs

Figure 14:
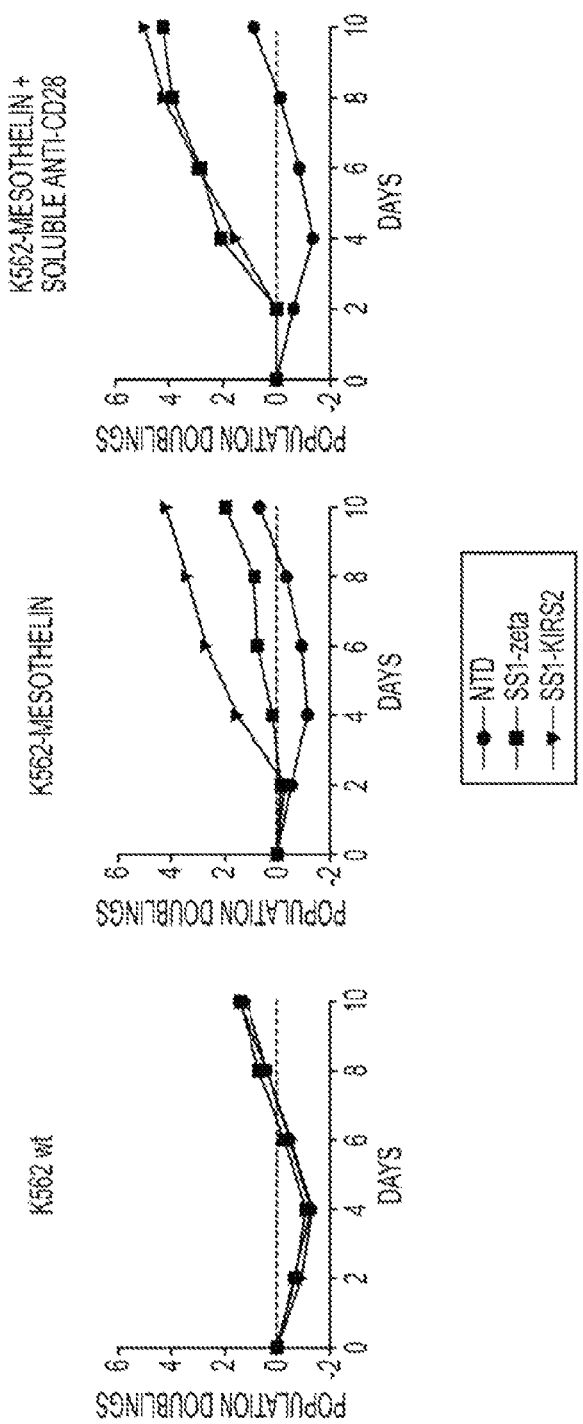
FIG. 14 illustrates the ability of a mesothelin-specific KIR-based CAR (SS1-KIRS2) to stimulate T cell proliferation that is antigen-dependent but independent of additional CD28 costimulation. Primary human T cells were stimulated with CD3/28 microbeads followed by lentiviral transduction of SS1-KIRS2 and DAP12 or the mesothelin-specific TCR-zeta CAR (SS1-zeta). Mock non-transduced cells (NTD) were used as a negative control. K562 target cells with either no mesothelin (K562 wt) or expressing mesothelin (K562-mesothelin) were mixed with the different T cells conditions as indicated at a 2:1 ratio of effector T cells to target cells. T cells stimulated with K562-mesothelin were further divided into a condition with or without a monoclonal anti-CD28 agonist antibody (clone 9.3) at 1 ug/mL. The number of viable T cells were enumerated by flow cytometry using bead-based counting at the indicated time points to calculate the number of population doublings following antigen stimulation.

Experiments were designed to evaluate the effects of chimeric co-stimulatory receptors (CCRs) in the KIR-CAR system compared to that described with standard CARs by Kloss et al. (Kloss et al., 2013, Nat Biotechnol 31(1):71-5). Experiments have also been designed to evaluate the costimulatory dependent activation requirements for KIRs by engaging the endogenous CD28 receptor in T cell using the agonist antibody, clone 9.3. As shown in FIG. 14, the KIRS2 CAR showed robust proliferation in response to mesothelin-positive targets in the absence of CD28 costimulation. This proliferation is superior to that observed with a TCR-zeta CAR where co-stimulation has been shown to be critical to proliferation. This data suggests that the KIR-based CAR may not have the same costimulation requirements as TCR-zeta CARs for antigen-specific proliferation (Milone et al., 2009, Mol Ther 17(8):1453-64; Carpenito et al., 2009, Proc Natl Acad Sci USA 106(9):3360-5), and this costimulation independence may be a significant advantage of KIR-based CARs to current TCR-zeta-based CARs. Experiments have been designed to evaluate the KIR-based CARs in humanized mice to test the KIR-based CAR against CARs with and without costimulatory domains in an in vivo pre-clinical setting (data and experiments in example 5 are also presented in example 6).

Example 6: Killer Immunoglobulin-Like Receptor (KIR)-Based Chimeric Antigen Receptors (CARs) Trigger Robust Cytotoxic Activity in Solid Tumors Chimeric antigen receptors (CARs) bearing an antigen-binding domain linked in cis to the cytoplasmic domains of CD3-ζ and costimulatory receptors provide a potent method for engineering T cell cytotoxicity towards tumors (Grupp et al., The New England journal of medicine, 368(16):1509-18, 2013; Brentjens et al., Science translational medicine, 5(177):177ra38, 2013; Porter et al., The New England journal of medicine, 365(8):725-33, 2011). An alternative chimeric receptor in which a single chain variable fragment (scFv) targeting mesothelin (SS1) was fused to the transmembrane and cytoplasmic domain of KIR2DS2, a stimulatory killer immunoglobulin-like receptor (KIR) normally expressed by natural killer (NK) cells is described herein. This SS1-KIRS2 KIR-based CAR triggers robust antigen-specific cytotoxic activity and effector function in vitro such as cytokine secretion and proliferation when introduced into human T cells in combination with adaptor molecule DAP12. T cells modified to express a KIR-CAR and DAP12 exhibit significantly enhanced anti-tumor activity in a resistant tumor xenograft model compared with T cells transduced with a standard CD3ζ-based CAR, suggesting that the KIR-based CAR can overcome inhibitory signals within tumors that limit second and third generation CD3ζ-based CARs. The data presented herein support future clinical evaluation of a KIR-based CAR in cancers including solid tumors.

"First generation" CARs were designed by the incorporation of a cytoplasmic domain containing the immunotyrosine-based activation motif (ITAM) into a single chimeric receptor that uses a single chain variable fragment (scFv) from an antibody for specific antigen targeting (Sadelain et al., Cancer discovery, 3(4):388-98, 2013). A number of different additional signaling domains from co-stimulatory receptors such as CD28, ICOS, 4-1BB and OX-40 were later incorporated in tandem into these receptors to enhance the proliferation, survival and function of T cells (Finney H M et al. J Immunol. 1998; 161:2791-2797; Maher J. et al. Nat Biotech 2002; 20:70-75; Finney H M et al. J Immunol. 2004; 18:676-684; Milone et al., 2009, Mol Ther 17(8):1453-64; Carpenito et al., 2009, Proc Natl Acad Sci USA 106(9):3360-5). These "second generation" (one co-stimulatory domain) and "third generation" (2 co-stimulatory domains) CARs demonstrate enhanced function in preclinical animal models of cancer, and several co-stimulation-enhanced CARs are currently in early phase human clinical trials for cancer (reviewed in Barrett D M et al. Ann Rev Med 2014; 65:333-347).

Although single-chain CARs trigger robust antigen-specific cytotoxic activity, natural receptors utilizing the highly conserved ITAM domains are generally structured into multi-chain complexes composed of separate ligand binding and ITAM-containing signaling chains, such as the T cell receptor (TCR)-CD3ζ complex, the B cell receptor (BCR)-Igα/β complex and the Fc receptor (FcR) complex. The potential benefits of a multi-chain immunoreceptor complex are manifold, including greater diversity of signals available through the multiple interactions between ligand binding and signaling molecules and sustained ITAM signaling that is separable from the internalization of the ligand-binding chain (Sigalov et al., Advances in experimental medicine and biology, 640:ix-xi, 2008). The consequences of combining several receptor components normally found in heterologous receptors into a CAR has not been fully elucidated; however, anergy and antigen-independent signaling have been observed with some designs (Brocker, Blood, 96(5):1999-2001, 2000; Brocker et al., The Journal of experimental medicine. 181(5):1653-9, 1995; Milone et al., Molecular therapy: the journal of the American Society of Gene Therapy, 17(8):1453-64, 2009).

The invention claimed herein describes CARs constructed upon a more "natural" multi-chain immunoreceptor design having greater potency in activating T cells due to the naturally-selected interactions between the subunits within the receptor complex and other receptors within immune cells. The killer immunoglobulin-like receptor (KIR) and DAP12 multichain immunoreceptor complex was chosen as the foundation for the CAR (Thielens et al., Current opinion in immunology, 24(2):239-45, 2012). Although expressed by natural killer cells where they contribute to their natural cytotoxicity, KIR expression has also been observed in both CD4+ and CD8+ T cells (Moretta et al., Immunological reviews, 155:105-17, 1997; Falk et al., Human immunology; 61(12):1219-32, 2000; Remtoula et al., Journal of immunology, 180(5):2767-71, 2008). Activating KIRs, such as KIR2DS2, possess a short cytoplasmic domain with no known endogenous signaling activity. However, KIRs form a non-covalent complex with dimers of DAP12, an ITAM-containing adaptor molecule capable of binding Syk and Zap70 kinases in NK cells (Lanier et al., Nature, 391(6668):703-7, 1998). In addition to stimulating cytotoxicity upon ligand binding, KIRs have also been shown to exhibit costimulatory effects within T cells in the absence of DAP12 suggesting that these molecules might be able to provide both primary triggering activity and costimulation in T cells (Snyder et al., Journal of immunology, 173(6):3725-31, 2004).

A KIR-based CAR was constructed by splicing the mesothelin-specific SS1 scFv onto the transmembrane and short cytoplasmic domain of the activating KIR, KIR2DS2 (SS1-KIRS2) as illustrated schematically in FIG. 1 (Hassan et al., Clinical cancer research: an official journal of the American Association for Cancer Research, 8(11):3520-6, 2002). The ITAM-containing adaptor molecule, DAP12 is constitutively expressed in natural killer (NK) cells, but it is only expressed in a subset of human T cells (Moretta et al.). Therefore, a bicistronic lentiviral vector encoding both the mesothelin-specific KIR-based CAR (SS1-KIRS2) and the DAP12 molecule separated by the Thoseaasigna virus 2A (T2A) sequence was generated in order to achieve co-expression of both molecules (FIG. 2). Transduction of primary human T cells with SS1-KIRS2 and DAP12 bicistroinic lentivirus following anti-CD3 and anti-CD28 activation demonstrated robust surface expression of SS1-KIRS2 that was comparable to the CD3ζ-based SS1ζ CAR (FIG. 6). SS1-KIRS2/DAP12 co-transduced T cells expanded following polyclonal anti-CD3/anti-CD28 stimulation with kinetics that was comparable to that observed with mock transduced T cells or T cells transduced with a mesothelin-specific CAR containing the CD3ζ cytoplasmic domain (data not shown). The cytotoxic activities of the KIR-based versus CD3ζ (SS1-z) CAR T cells was compared. SS1-KIRS2/DAP12-transduced T cells showed potent cytotoxic activity towards K562 cells that express human mesothelin (K-meso) with similar magnitude to the SS1ζ construct. None of the engineered T cells demonstrate lytic activity towards wild-type K562 (Kwt) supporting the specific activation of the SS1-KIRS2 receptor by the cognate mesothelin target antigen (FIG. 6).

Figure 12:
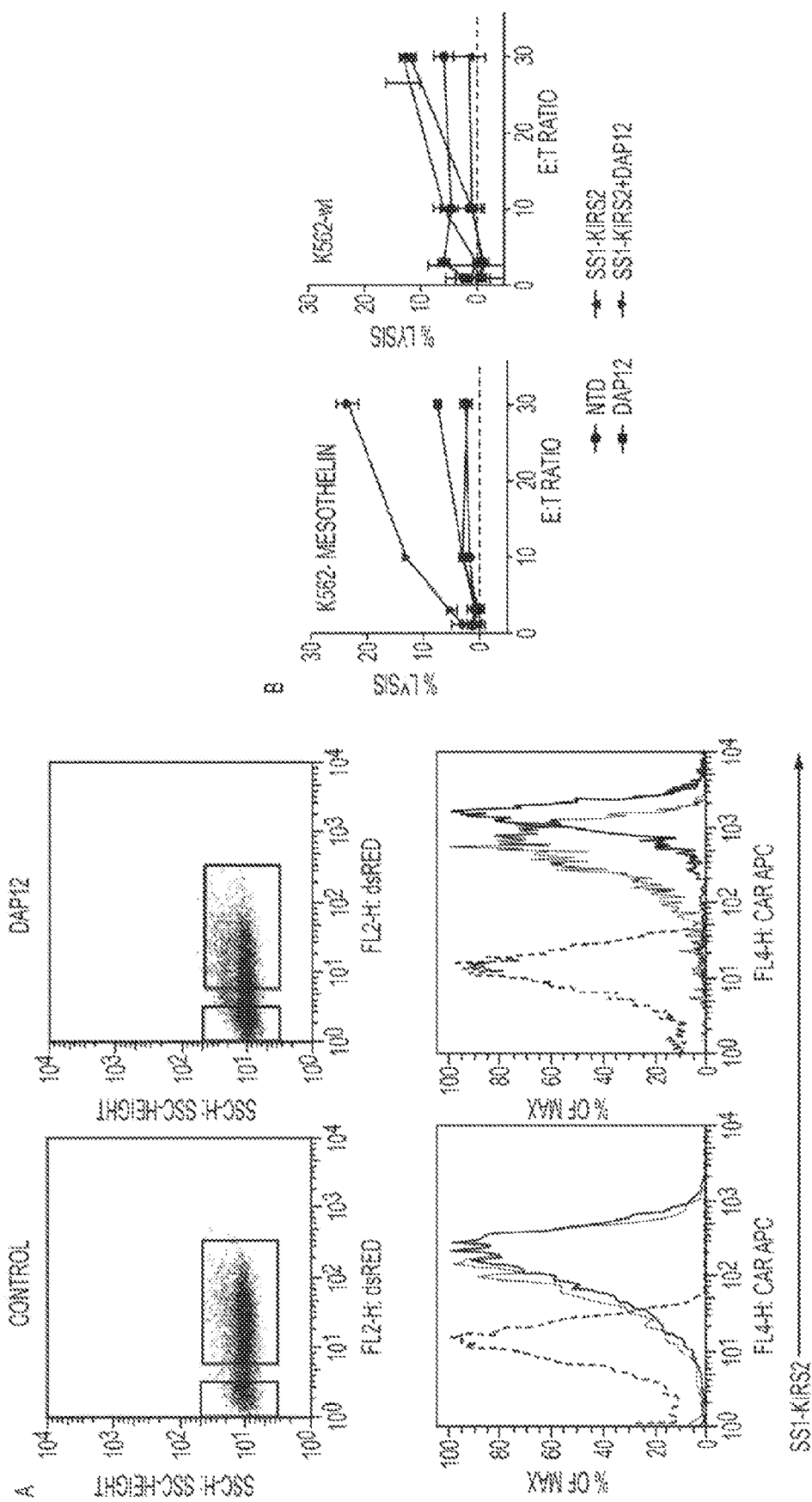
FIG. 12, comprising

Since expression of KIR2DS2 has been described in T cells in the absence of detectable DAP12 expression, the expression and function of the SS1-KIRS2 receptor with or without co-delivery of DAP12 was evaluated. Using a lentiviral vector that co-expressed DAP12 with the red fluorescent protein, dsRed (DAP12-dsRed) or a dsRed-expressing control vector (dsRed), T cells were transduced with the lentiviral DAP12 or control vector followed by transfection with in vitro transcribed RNA expressing SS1-KIRS2. SS1-KIRS2 was expressed at the surface of T cells without the addition of DAP12; however, the surface expression of SS1-KIRS2 increased by ~1-log with the addition of DAP12 (FIG. 12A). Despite the expression of SS1-KIRS2, T cells without DAP12 do not lyse mesothelin-expressing target cells demonstrating a requirement for DAP12 in SS1-KIRS2-triggered T cell cytotoxic activity (FIG. 12B). These data do not preclude the possibility that the chimeric KIR might provide signals independently of its association with DAP12 as previously reported for the natural KIR2DS2 receptor in T cell clones (Snyder et al.).

Figure 13:
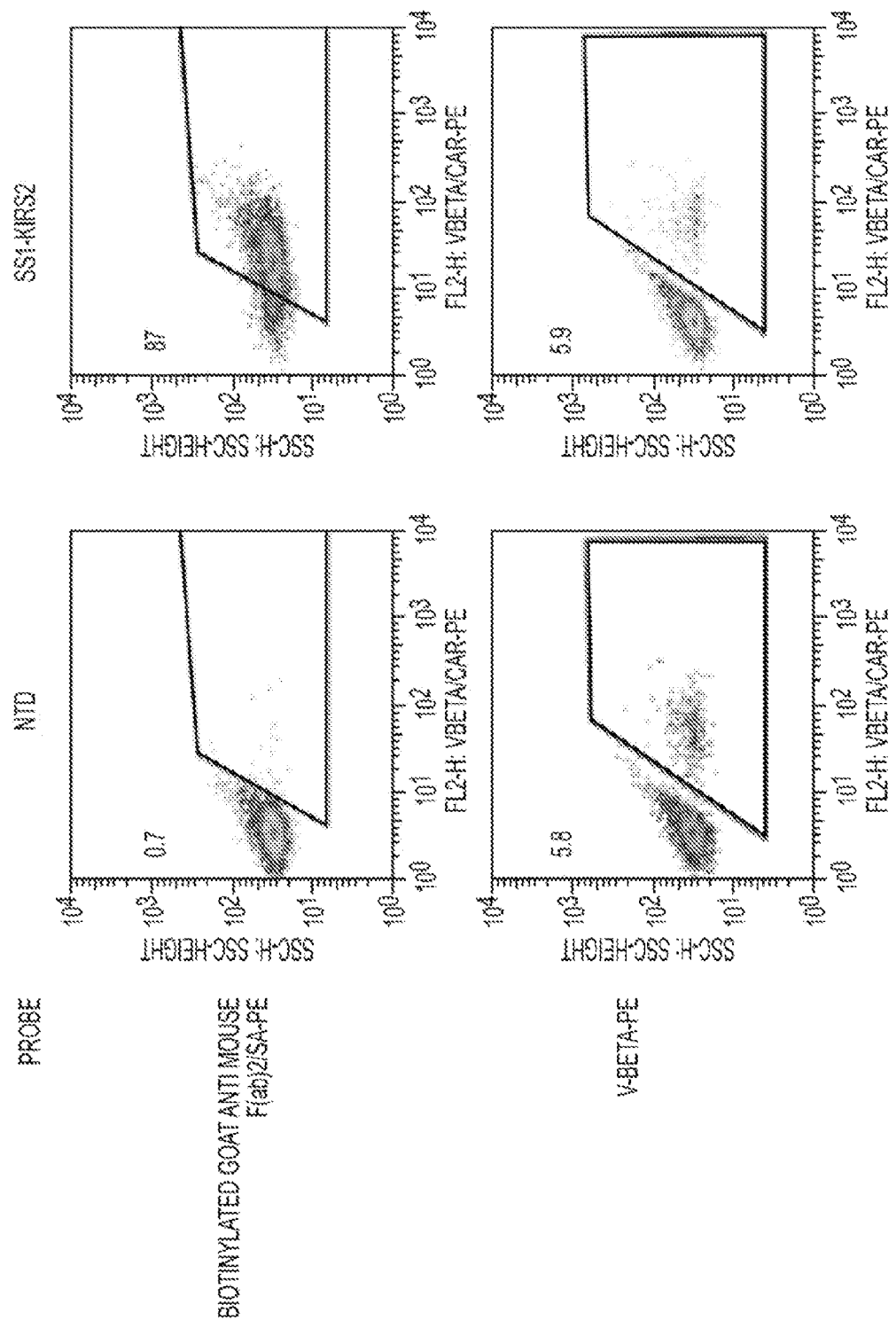
FIG. 13 shows that the expression of an endogenous TCR is unaffected by SS1-KIRS2 and DAP12 expression. $5\times10^6$ primary human T cells were electroporated with 10 ug of in vitro transcribed RNA encoding SS1-KIRS2 or mock transfected using a BTX ECM830 electroporator. After overnight incubation, the transfected T cells were stained for the expression of SS1-KIRS2 using a biotinylated goat anti-mouse F(ab)2 specific polyclonal antibody followed by streptavidin-PE. The expression of Vβ13.1 was assessed using a PE-conjugated monoclonal antibody specific to this Vβ chain of the TCR.

The non-covalent association of natural KIR2DS2 and DAP12 depends upon the electrostatic interactions between an aspartic acid residue in the KIR transmembrane (TM) domain and a lysine residue in the DAP12 TM domain (Feng et al., PLoS biology, 4(5):e142, 2006). Although the configuration of these ionizable amino acid residues in the TM domains of TCR and CD3 subunits are thought to differ from the KIRs and DAP12, providing some specificity for the interactions, the possibility that SS1-KIRS2 might be interacting with components of the CD3 complex in lieu of co-delivered DAP12 was investigated. Since the association between the CD3 complex and TCR chains is required for TCR expression on the cell surface, competition of the KIR for CD3 components would be expected to interfere with normal TCR expression as previously observed with expression of cloned TCRs. The introduction of an ectopic Vβ chain into T cells has been shown to reduce the surface expression of endogenous TCR Vβ due to competition during complex assembly (Varela-Rohena et al., Nature medicine, 14(12):1390-5, 2008). The similar frequency and intensity of TCR Vβ 13.1+ in KIRS2-transduced polyclonal T cells compared with mock-transduced, control T cells supports the absence of a significant interaction between SS1-KIRS2 and members of the endogenous CD3 complex (FIG. 13).

Figure 10:
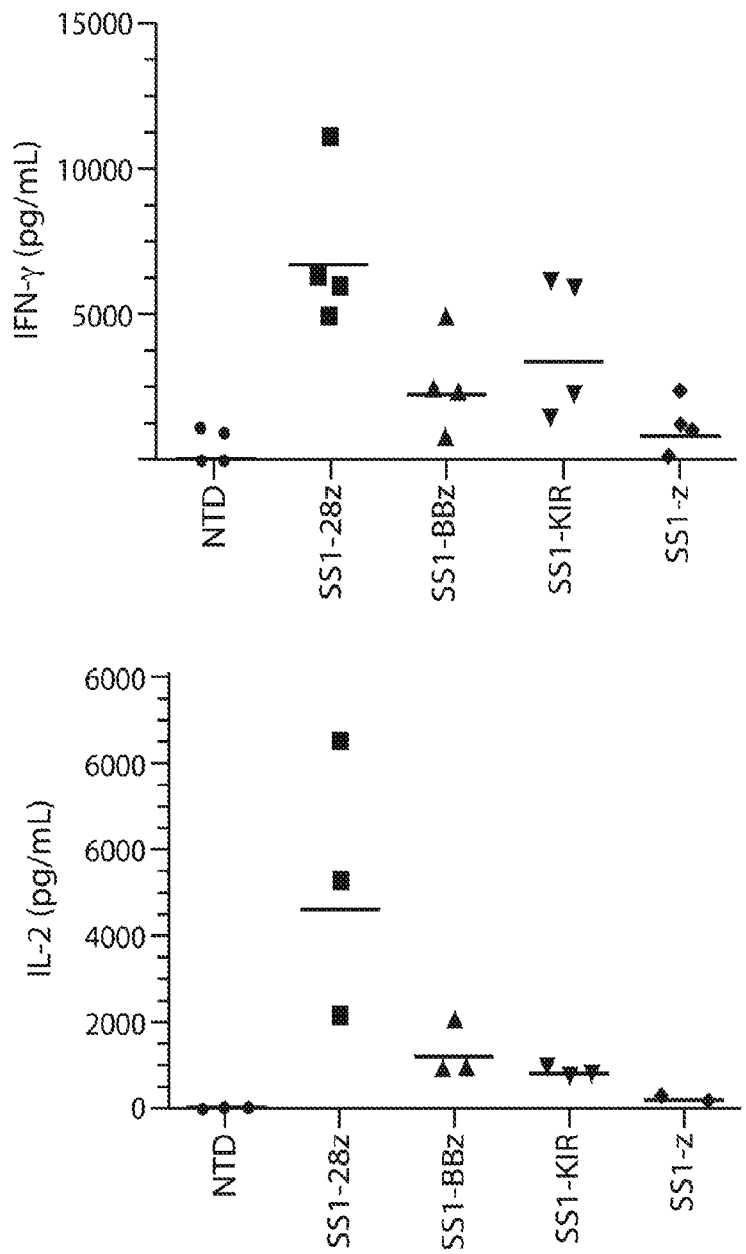
FIG. 10 is an image demonstrating the interferon-gamma (IFN-γ) and interleukin-2 production by T cells from a donor expressing a mesothelin-specific activating KIR-based CAR (SS1-KIRS2) or TCR-zeta based CAR with or without a costimulatory domain (SS1-z, SS1-28z or SS1-BBz). Primary human T cells were simulated, followed by lentiviral transduction with the indicated activating KIR CAR or TCR-zeta based CAR. Following expansion, the transduced T cells were mixed with K562 (Kwt) or K562-mesothelin cells (Kmeso) at a ratio of 2:1. Cytokine concentrations were determined in supernatants following 24 hours of stimulation by ELISA for the indicated cytokines in multiple independent donors. Repeated measure ANOVA demonstrated a significant CAR effect on IFN-γ (p=0.002) and IL-2 (p=0.0156). SS1-KIRS2/DAP12 (SS1KIR) vs. mock for IFN-γ (posthoc paired t-test, p=0.0162). SS1-KIR vs. SS1-28z for IL-2 (post-hoc paired t-test, p=0.0408)
Figure 11:
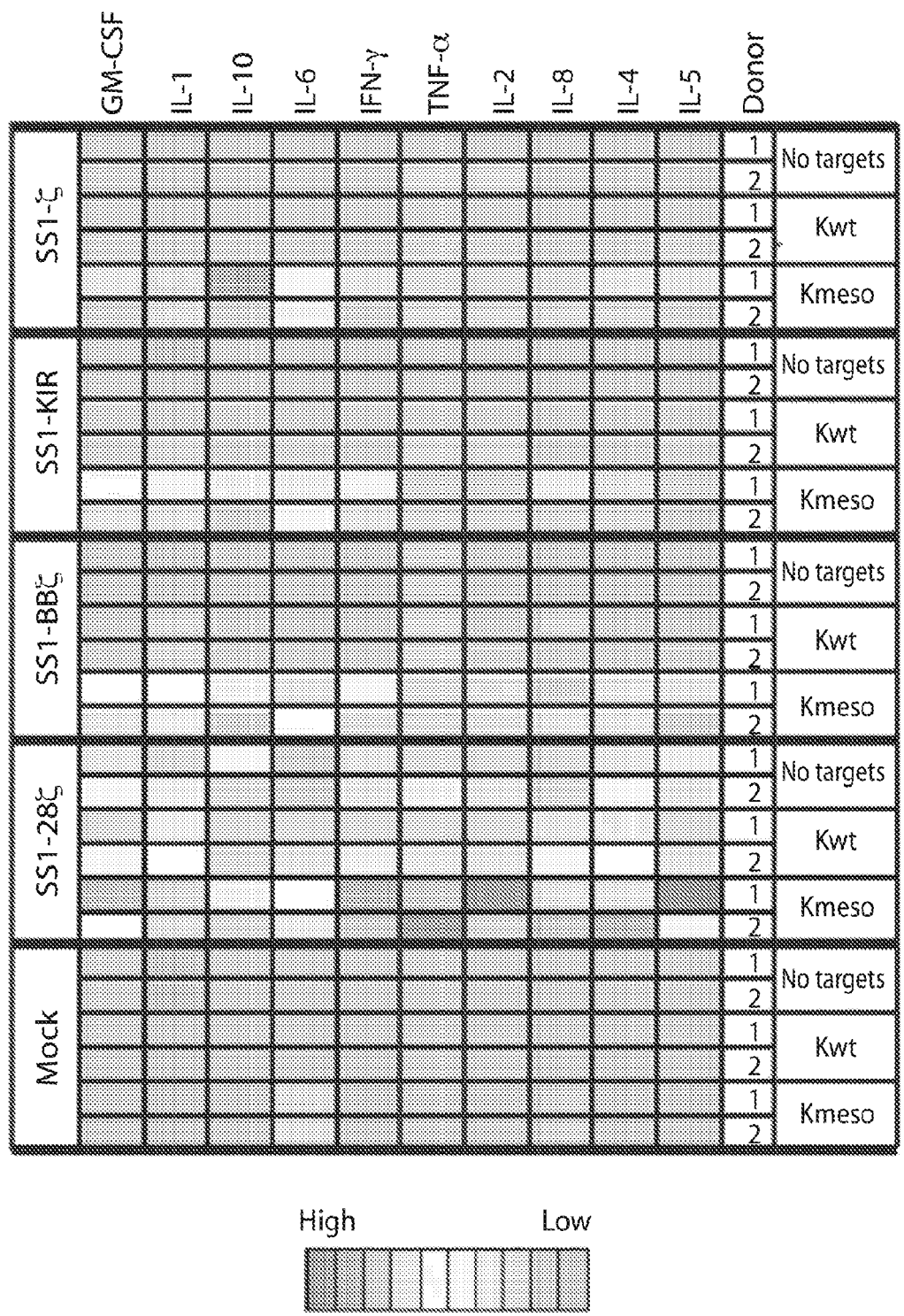
FIG. 11 is a heat map of cytokine concentrations in supernatants as assessed by a multiplex luminex-based immunoassay (Cytokine Human 10-Plex Panel, Life Technologies). A heatmap of relative concentration after normalization across donor and conditions to the lowest concentration for each cytokine was generated using the heatmap package implement in R statistical software.

Although cytotoxic activity is an important effector function for in vivo anti-tumor activity of T cells, the ability of an antigen-receptor to trigger cytokine secretion and T cell proliferation are also important characteristics that generally correlate with robust anti-tumor activity in vivo. Therefore, antigen-triggered interferon-γ (IFN-γ) and interleukin-2 (IL-2) secretion by SS1-KIRS2/DAP12-modified T cells to T cells bearing a CD3ζ-based CAR without a costimulatory domain (SS1-ζ) or with CD28 or 4-1BB co-stimulatory domains (SS1-28 and SS1-BBζ, respectively, was compared. The SS1-ζ construct stimulates the lowest secretion of both IFN-γ and IL-2 (FIG. 10, 11). Interferon-γ production is increased and comparable in T cells expressing SS1-KIRS2/DAP12 or SS1-BBζ whereas T cells expressing the SS1-28ζ CAR show significantly greater IL-2 and IFN-γ production (FIG. 10). Analysis of a larger panel of cytokines and chemokines demonstrates that SS1-KIRS2/DAP12 stimulates a pattern of expression that is qualitatively similar across CD3ζ-based CARs with a magnitude of antigen-induced cytokine and chemokine secretion that is comparable to SS1-ζ and SS1-BBζ CARs (FIG. 11).

The SS1-KIRS2/DAP12 receptor was also a potent stimulator of T cell proliferation in response to cognate antigen (FIG. 14). Unlike the standard SS1-ζ CAR that depends upon additional costimulatory signals for robust proliferation, SS1-KIRS2/DAP12 T cells show proliferation that is comparable to SS1ζ with addition of anti-CD28 agonist antibody. The mechanism of the costimulation provided by SS1-KIR2 in the absence of DAP12 might be related to KIR interactions with other adaptor molecules (Synder et al.). Additional receptors naturally expressed by T cells may also be capable of utilizing the co-delivered DAP12 further contributing to T cell activation and proliferation. In particular, integrins can provide costimulatory signals to T cells (Brunmark et al. (1996) PNAS USA 93(25):14736-41; Zuckerman et al. (1998) J. Immunol. 160(7):3259-68). DAP12 appears critical to outside-in signaling by integrins in macrophages and neutrophils (Jakus et al. (2007) Trends in Cell Biol. 17(10):493-501; Mocsai et al. (2006) Nature Immunol. 7(12):1326-33), and may confer unique signaling activity to LFA-1 and other integrins in T cells contributing to SS1-KIRS2/DAP12 activity.

CD28 and 4-1BB have been incorporated into CARs to enhance CAR T cell activity in vivo (Carpenito et al. (2009) PNAS USA 106(9):3360-65); however, costimulation is not always able to overcome the immunosuppressive tumor microenvironment. It was recently reported that SS1-BBζ CAR T cells injected into immunodeficient NOD-SCID-$\gamma_c^{-/-}$ (NSG) mice bearing a xenograft of EM-meso cells (a cell line derived from the pleural effusion of a patient with malignant mesothelioma) expand in vivo, but become hypofunctional within the tumor microenvironment associated with failure to clear tumors (Moon et al. (2014) Clinical Cancer Res. 20:4262-4273). The activity of SS1-KIRS2/

Figure 15:
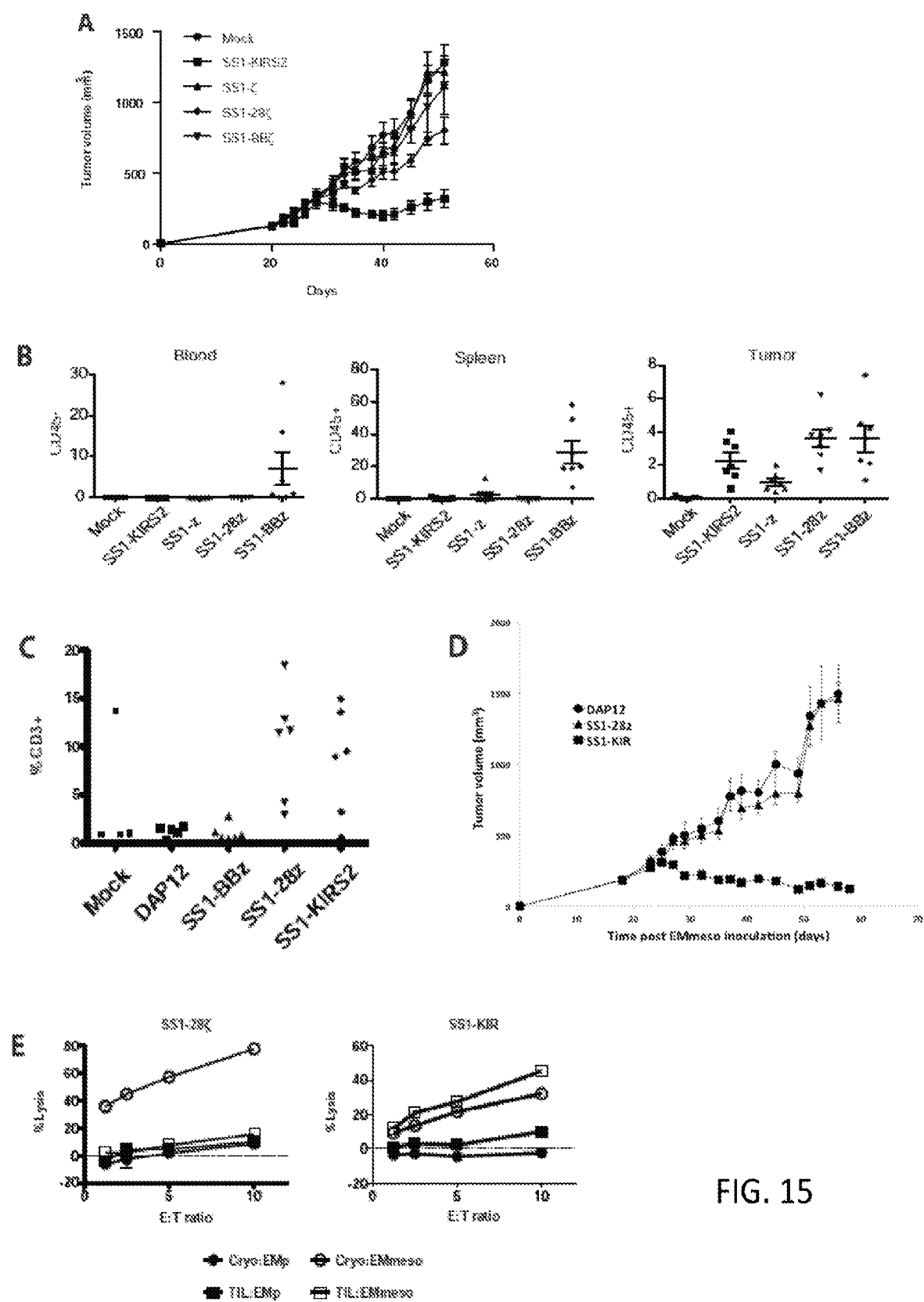
FIG. 15, comprising FIGS. 15A, 15B, 15C, 15D, and 15E, demonstrates that mesothelin-specific KIR-CAR modified T cells show enhanced anti-tumor activity in vivo compared with second generation TCR-ζ based CARs bearing CD28 or CD137 (4-1BB) costimulatory domains.
Figure 16:
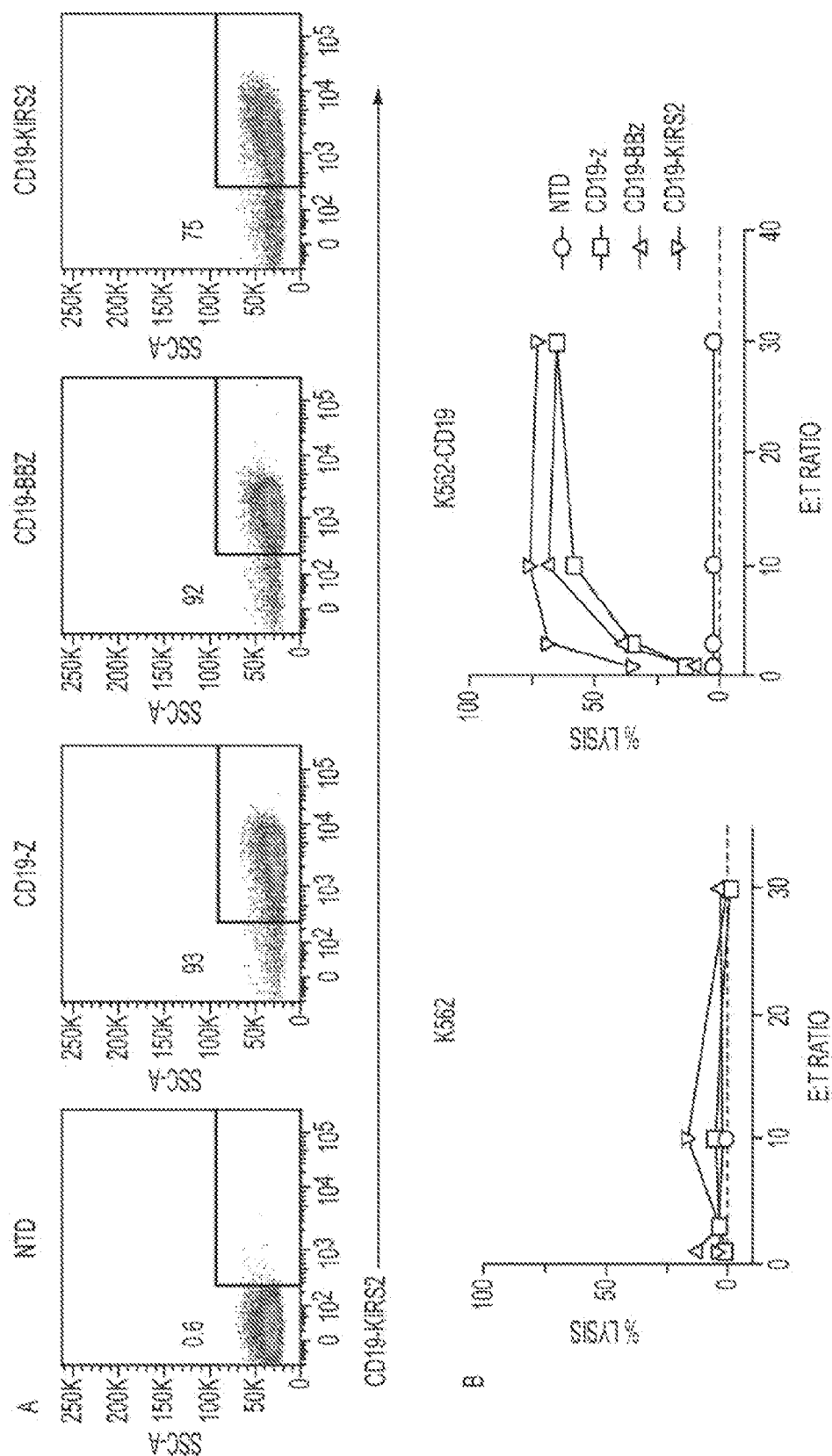
FIG. 16, comprising FIGS. 16A and 16B, demonstrates a KIR-based CAR with CD19 specificity can trigger antigen-specific target cell cytotoxicity. Following anti-CD3/anti-CD28 bead activation, T cells were transduced with a bicistronic lentiviral vector expressing DAP12 along with either a CD19-specific KIR-based CAR in which the FMC63-derived scFv is fused to full length KIR2DS2 (CD19-KIR2DS2) or a KIR-based CAR generated by fusing the FMC63 scFv to the transmembrane and cytoplasmic domain of KIR2DS2 via a short linker [Gly]$_4$-Ser linker (CD19-KIRS2). The transduced T cells were cultured until the end of the log phase growth, and the expression of the CD19-specific KIR-based CAR was assessed by flow cytometry using a biotinylated goat-anti-mouse F(ab)$_2$ polyclonal antibody followed by SA-PE. $^{51}$Cr-labeled K562 target cells with (K562-CD19) or without (K562-wt) CD19 expression were mixed at varying ratios with T cells to target cells (E:T ratio). Cytotoxicity was determined by measuring the fraction of $^{51}$Cr released into the supernatant at 4 hours. Control T cells that were either mock transduced (NTD) or transduced with a CD3ζ-based CAR specific to CD19 (CD19-z) were also included as negative and positive controls, respectively.
Figure 36:
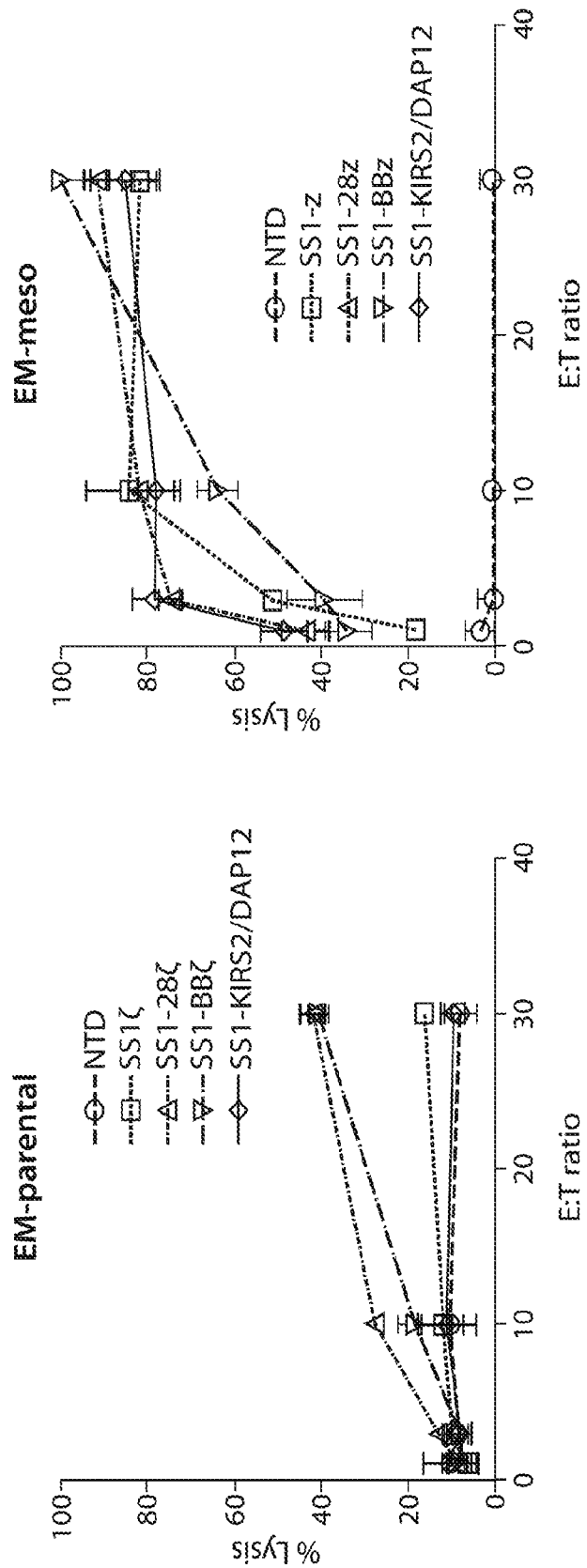
FIG. 36 shows that mesothelin-specific CD3ζ and KIR-based CARs have similar antigen specific in vitro cytotoxicity toward mesothelioma-derived cells expressing mesothelin (EM-meso cells). Primary human T cells were stimulated with anti-CD3/CD28 stimulator beads and transduced with a lentiviral vector expressing the SS1-KIRS2 mesothelin-specific CAR. Following expansion, T cells were mixed with $^{51}$Cr-labeled K562 cells expressing EM-meso at the indicated effector to target (E:T) ratio. % lysis was determined.
Figure 38:
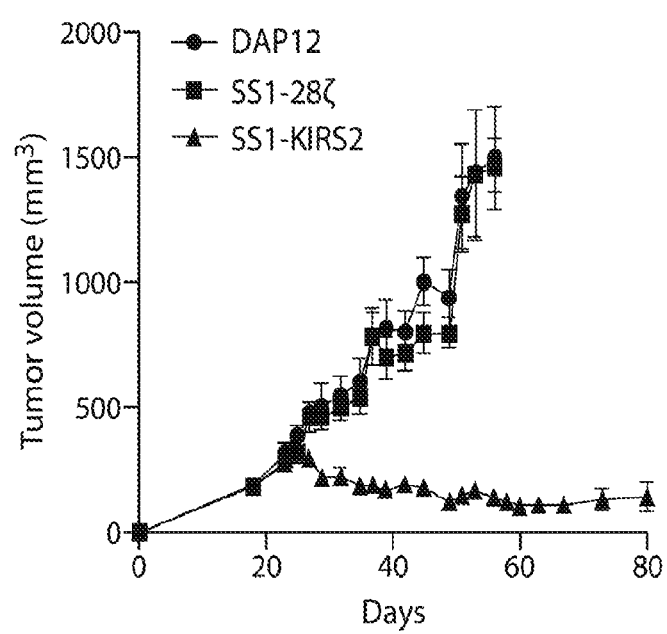
FIG. 38 shows that SS1-KIRS2/DAP12 T cells mediate robust anti-tumor activity in vivo. NOD-SCID-γc−/− (NSG) mice were injected subcutaneously with 2×10$^6$ mesothelioma-derived cells expressing mesothelin (EM-meso cells). 5×10$^6$ primary human T cells transduced with the indicated CAR were injected IV on day 20. Tumor volume was measured by caliper at the indicated times.

DAP12-modified T cells was evaluated in this highly resistant model of mesothelioma. SS1-KIRS2/DAP12 and CD3ζ-based CARs with or without costimulation are able to lyse EM-meso cells in vitro with comparable efficacy. Mock-transduced and DAP12-dsRed-transduced T cells show minimal lytic activity towards EM-meso cells (FIG. 36). A single intravenous injection of mock, SS1ζ, and the SS1BBζ-transduced T cells had no observable anti-tumor effect on established EM-meso xenografts (FIG. 15A). Tumor growth was significantly delayed by SS1-28ζ CAR T cells; however, only SS1-KIRS2/DAP12-modified T cells induced regression of tumors with significant suppression of EM-meso tumor growth at 52 days (p<0.001, ANOVA with post-hoc Scheffe F-test). A second experiment comparing T cells expressing SS1-KIRS2/DAP12 to DAP12 alone or SS1-28ζ engineered T cells showed similar enhanced anti-tumor activity of SS1-KIRS2/DAP12 T cells (FIG. 38). The robust activity of a KIR-based CAR is not unique to the mesothelin specificity. A CD19-specific KIR-based CAR was also constructed with in vitro activity comparable to second generation CD3ζ CARs (FIG. 16B). Testing in a NALM-6 leukemia xenograft model also showed KIR-CAR efficacy superior to a first generation CAR and comparable to a second generation CAR with a 4-1BB costimulatory domain.

Figure 37:
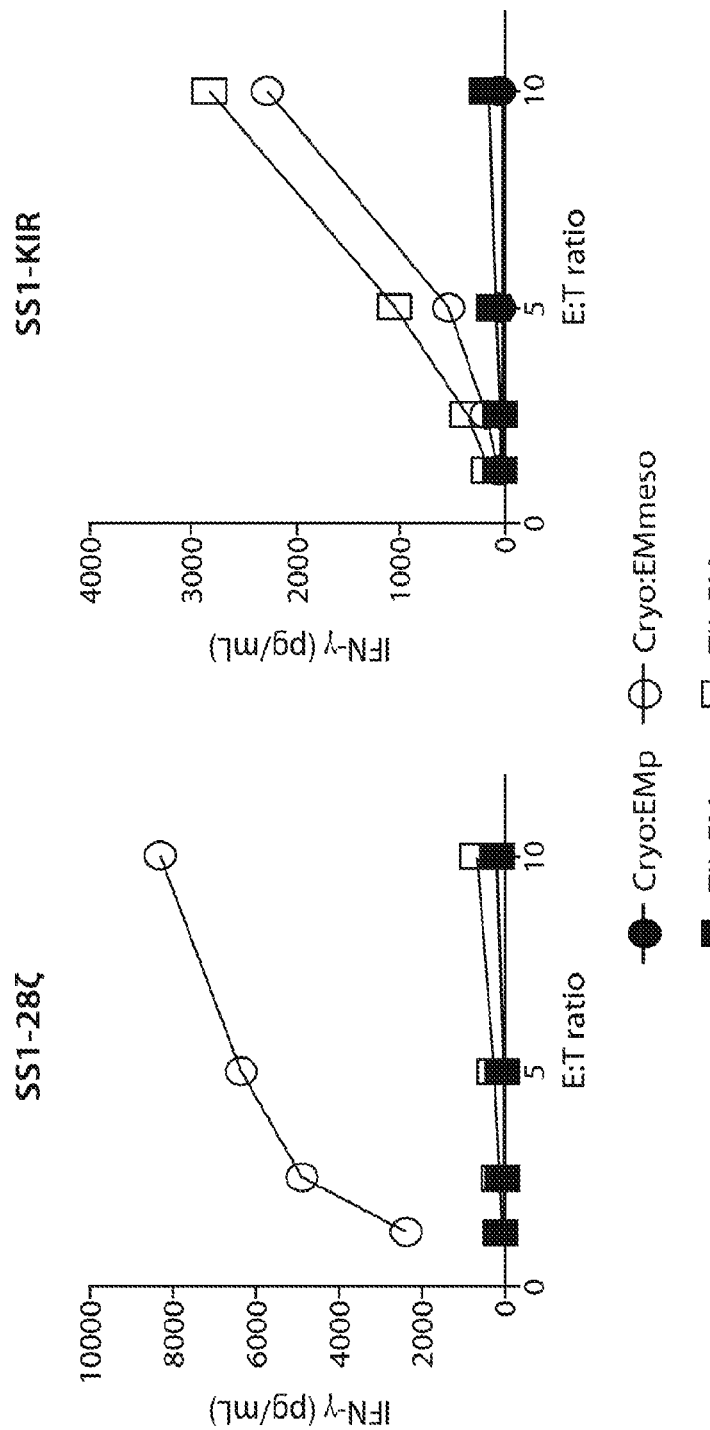
FIG. 37 shows that TILs from 28ζCART treated mice lost IFNγ secretion with stimulation with mesothelioma-derived cells expressing mesothelin (EM-meso cells). NOD-SCID-γc−/− (NSG) mice were injected subcutaneously with 2×10$^6$ EM-meso cells. 5×10$^6$ primary human T cells transduced with the indicated CAR were injected IV on day 16. 18 days post CAR T cells infusion, TILs were isolated with CD45 magnetic beads and mixed with EM-meso at the indicated effector to target (E:T) ratio. Cytokine concentrations were determined in supernatants by ELISA.

Analysis of T cell engraftment and tumor infiltrating lymphocytes (TILs) was performed to explore the mechanism of the enhanced anti-tumor activity of SS1-KIRS2/DAP12 T cells in the EM-meso xenograft model. Only mice receiving the SS1-BBζ CAR T cells had detectable human CD45 (hCD45) positive cells in the blood and spleen consistent with the previously observed effect of the 4-1BB costimulatory domain on in vivo CAR+ T cell persistence (Milone et al.). Few hCD45+ tumor infiltrating lymphocytes (TILs) were detected in mock or SS1ζ-treated mice. In contrast, tumors treated with SS1-KIRS2/DAP12, SS1-28ζ, and SS1-41BBζ CAR T cells had hCD45+ TILs that comprised 2-4% of the total viable cells with comparable frequencies for each group (FIG. 15B). Immunohistochemical staining showed both CD8+ and CD4+ TILs (data not shown) within the tumors of SS1-KIRS2/DAP12, SS1-28ζ, and SS1-41BBζ CAR T cell-treated mice confirming the flow cytometry analysis. The increased efficacy of the SS1-KIRS2/DAP12 T cells is therefore unrelated to the TIL frequency within the tumors at late stages of tumor growth. Since comparison of TILs is limited by the large differences in tumor volume at the late time points, earlier time points following T cell injection were evaluated. At 10 days following T cell injection, comparable frequencies of hCD45+ TILs were observed in SS1-28ζ and SS1-KIRS2/DAP12 CAR T cell treated groups, but few CD45+ TILs were present in the SS1-BBζ CAR T cell group (FIG. 15B). Limited analysis of these isolated TILs showed that only SS1-KIRS2/DAP12 CAR T cell were capable of in vitro lytic activity towards EM-meso cells (data not shown). These results indicate that delayed accumulation of SS1-BBζ T cells into the tumor along with tumor-induced hypofunction underlies the poor anti-tumor activity of these cells despite their high frequency at late stages of tumor development. A repeat experiment was conducted comparing SS1-28ζ and SS1-KIRS2/DAP12 CAR T cells with TIL isolation at 18 days following T cell injection to obtain greater numbers of TILs for phenotypic and functional analysis. Isolated SS1-28ζ TILs demonstrated markedly reduced cytotoxic activity and antigen-specific IFN-γ production compared to cryopreserved T cells used for treatment. In contrast, the TILs from SS1-KIRS2/DAP12 CAR T cell-treated tumors showed comparable in vitro cytotoxicity and IFN-γ production to cryopreserved cells (FIG. 15E and FIG. 37). Immunoblotting of protein lysates from the TILs and cryopreserved cells for CAR protein demonstrated loss of CAR expression (data not shown). The absence of CAR in the TILs may be due to downregulation of expression or poor survival of the SS1-28ζ CAR T cells relative to non-transduced T cells within the tumor microenvironment.

In conclusion, the data presented herein demonstrate that the combination of KIR-based CAR and DAP12 provides a highly effective, antigen-specific receptor system for conferring artificial antigen specificity to T cells. Despite relative equivalent in vitro activity, it has further been shown that this KIR-based CAR has much improved anti-tumor efficacy compared to CARs based on CD3ζ with one or more costimulatory domains in the model tumor system utilized herein, perhaps due to increased resistance to inactivation. Further exploration into the mechanisms of this increased efficacy and of chimeric receptor designs based upon other DAP12-associated ligand-binding receptors, as well as additional natural ITAM containing receptors systems such as FcRγ, will be pursued.

Figure 20:
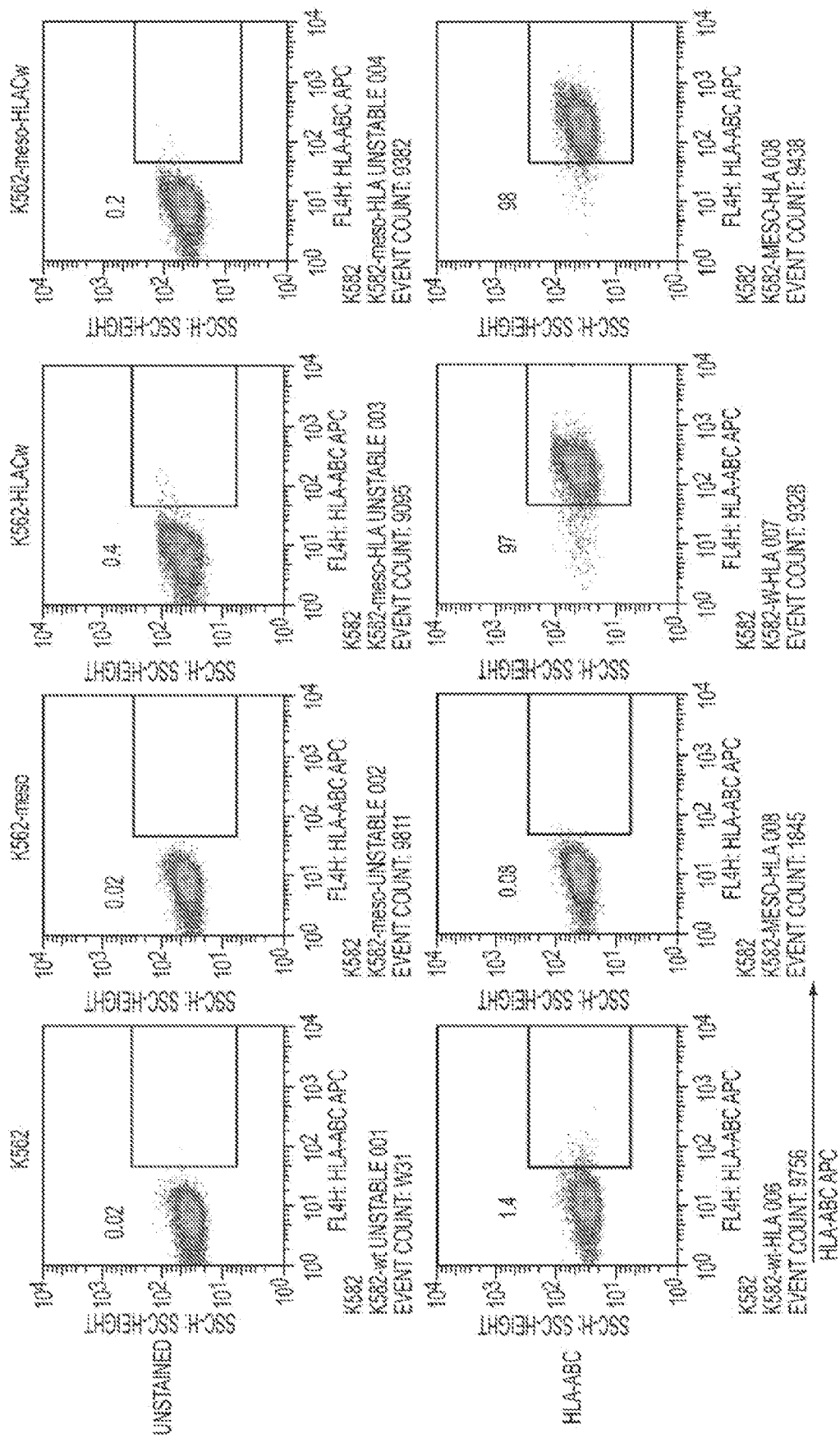
FIG. 20 demonstrates the generation and characterization of a K562-meso cell line that express the KIR2DL3 ligand HLA-Cw. K562 cells (K562) or K562 cells expressing mesothelin (K562-meso) were transduced with the HLA-Cw3 allele followed by fluorescence activated cell sorting to obtain K562 cells expressing HLA-Cw with (K562-meso-HLACw) or without (K562-HLACw) expression of mesothelin. HLA-Cw3 expression was assessed by flow cytometry using an APC-conjugated monoclonal antibody that recognizes HLA-A, B and C alleles (clone W6/32).
Figure 21:
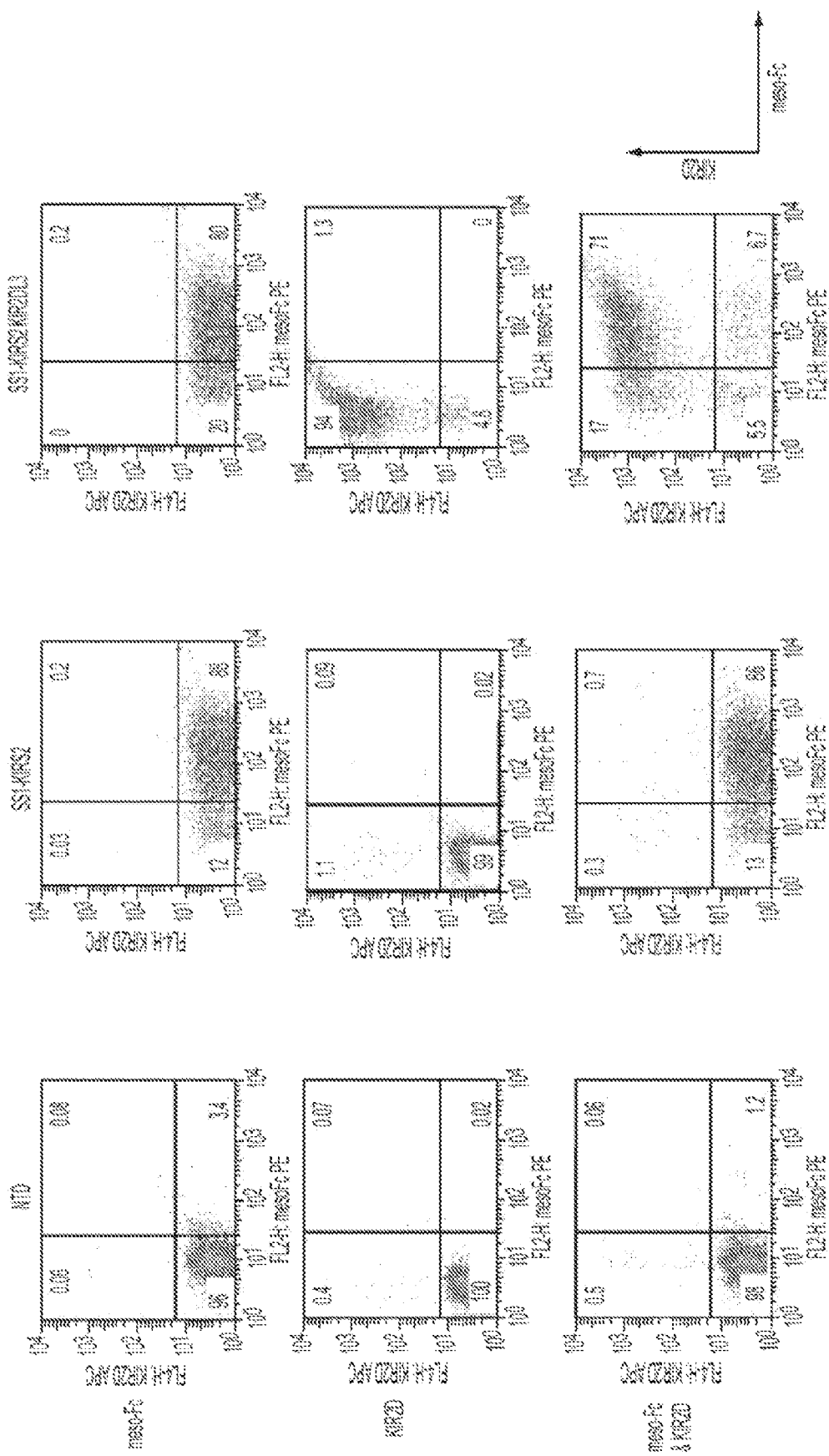
FIG. 21 demonstrates co-expression of SS1-KIRS2 and KIR2DL3 in primary human T cells. Primary human T cells were stimulated with CD3/28 microbeads followed by lentiviral transduction with SS1-KIRS2 and DAP12 (SS1-KIRS2) or mock transduced (NTD) in combination with wild-type KIR2DL3. The T cells were expanded until the end of log-phase growth. The surface expression of the mesothelin-specific CAR and KIR2DL3 was determined by staining with mesothelin-Fc followed by PE-conjugated goat-anti-human Fc and a monoclonal antibody to the KIR2DL3 ectodomain.

Example 7: A KIR-Based CAR can be Co-Expressed with a Natural Inhibitory KIR Permitting Regulation by HLA Expression on the Target Cells Generation and Characterization of a K562-Meso Cell Line that Express the KIR2DL3 Ligand HLA-Cw
Material and Method:
Wild type K562 cells or a K562 line previously engineered to express mesothelin (K562-meso) were transduced with a lentiviral vector encoding the HLA-Cw3 allele. Cells were sorted for uniform expression of mesothelin and HLA-Cw3 by fluorescence-activated cell sorting. HLA-Cw3 expression was confirmed by flow cytometry following staining with the W6/32 anti-HLA A, B, C antibody conjugated to APC.
Result:
K562 cell lines expressing either mesothelin or HLA-Cw3 alone or in combination can be generated (FIG. 20).
Co-Expression of SS1-KIRS2 and KIR2DL3 in Primary Human T Cells
Material and Method:
Primary human T cells were stimulated with anti-CD3/28 microbeads followed by transduction with either a bicistronic lentiviral vector expressing DAP12 and SS1-KIRS2 alone or in combination with a lentiviral vector expressing KIR2DL3 on day 1 following activation. The expression of the SS1-KIRS2 CAR was assessed by flow cytometry using a biotinylated goat-anti-mouse F(ab)2 polyclonal antibody followed by SA-APC. KIR2DL3 expression was determined using a KIR2D specific monoclonal antibody.
Result:
Primary human T cells expressing a mesothelin-specific KIR-based CAR with DAP12 (KIRS2) alone, KIR2DL3 alone or a combination of the two receptors can be generated (FIG. 21).
KIR2DL3 Coexpressed with a KIR CAR can Suppress Antigen Specific Cytotoxicity in the Presence of HLA-Cw on the Target Cells
Material and Method:
Primary human T cells were stimulated with anti-CD3/28 microbeads followed by transduction with a bicistronic lentiviral vector expressing DAP12 and SS1-KIRS2. 5 μg of in vitro transcribed mRNA encoding KIR2DL3 was introduced into the lentivirally-transduced T cells by electroporation following 10 days of ex vivo expansion. These T cell populations were mixed with $^{51}$Cr-labeled K562 target cells (K562, K562-meso, K562-HLACw and K562-meso/HLACw) as indicated at varying ratios of effector T cells to target K562 cells (E:T ratio). Cytotoxicity was determined by measuring the fraction of $^{51}$Cr released into the supernatant at 4 hours.

Figure 22:
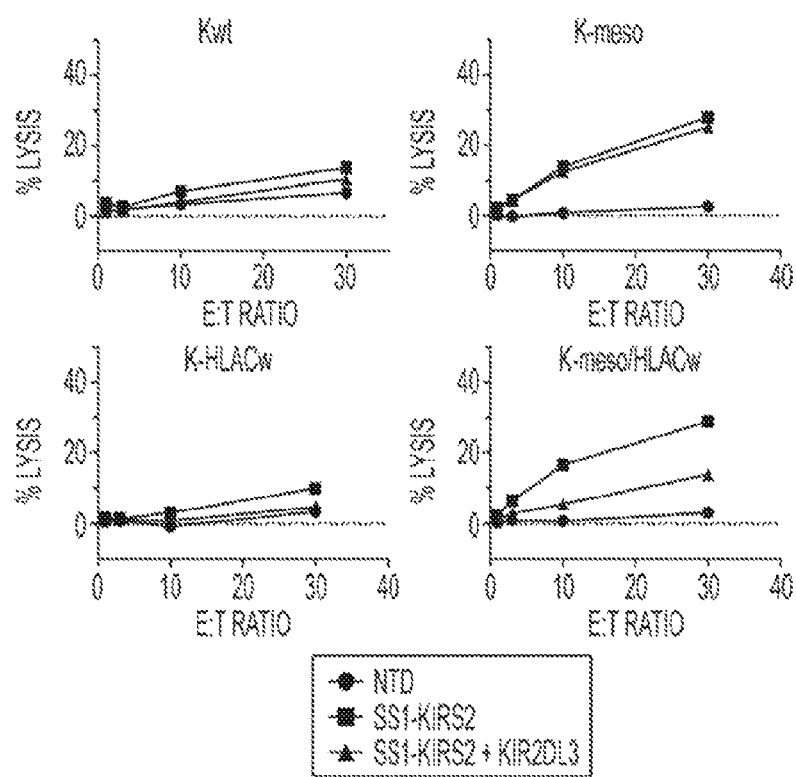
FIG. 22 demonstrates that KIR2DL3 coexpressed with a KIR CAR can suppress antigen specific cytotoxicity in the presence of HLA-Cw on the target cells. T cell that were generated and characterized as described in FIG. 21 were mixed with 51-Cr labeled target K562 cells that were generated and characterized as described in FIG. 22. Cytotoxicity was determined by measuring the fraction of $^{51}$Cr released into the supernatant at 4 hours compared target cells without effector cells.

Result:

SS1-KIRS2/DAP12-expressing T cells were capable of killing target K562 cells that express mesothelin regardless of HLA-Cw3 expression. In contrast, T cells co-expressing the SS1-KIRS2/DAP12 receptor complex and the inhibitory KIR, KIR2DL3 failed to exhibit robust cytotoxicity against K562 expressing mesothelin with HLA-Cw3; however, these cells demonstrated cytotoxic activity towards K562 cells expressing mesothelin alone that was comparable to SS1-KIRS2/DAP12-modified T cells. These results demonstrate the ability of inhibitory KIR receptors to regulate the functional activity of activating KIR-based CARs (FIG. 22).

Example 8: A KIR-Based CAR with CD19 Specificity can Trigger Antigen-Specific Target Cell Cytotoxicity In Vitro and In Vivo A KIR-Based CAR with CD19 Specificity can Trigger Antigen-Specific Target Cell Cytotoxicity In Vitro Material and Method:

Following anti-CD3/anti-CD28 bead activation, T cells were transduced with a bicistronic lentiviral vector expressing DAP12 along with either a CD19-specific KIR-based CAR in which the FMC63-derived scFv is fused to full length KIR2DS2 (CD19-KIR2DS2) or a KIR-based CAR generated by fusing the FMC63 scFv to the transmembrane and cytoplasmic domain of KIR2DS2 via a short linker [Gly]$_4$-Ser linker (CD19-KIRS2). The transduced T cells were cultured until the end of the log phase growth, and the expression of the CD19-specific KIR-based CAR was assessed by flow cytometry using a biotinylated goat-anti-mouse F(ab)$_2$ polyclonal antibody followed by SA-PE. $^{51}$Cr-labeled K562 target cells with (K562-CD19) or without (K562-wt) CD19 expression were mixed at varying ratios with T cells to target cells (E:T ratio). Cytotoxicity was determined by measuring the fraction of $^{51}$Cr released into the supernatant at 4 hours. Control T cells that were either mock transduced (NTD) or transduced with a CD3ζ-based CAR specific to CD19 (CD19-z) were also included as negative and positive controls, respectively.

Result:

Flow cytometric analysis demonstrates expression of the CD19-specific scFv on the surface of the T cells transduced with CD19-KIR2DS2, CD19-KIRS2 and CD19-z (FIG. 16A). T cells expressing DAP12 with either CD19-KIR2DS2 or CD19-KIRS2 were capable of killing target cells in an antigen-specific manner (FIG. 16B). Cytotoxicity exhibited by the KIR-based CAR-modified T cells was comparable to or higher than T cells expressing a CD19-specific CD3ζ-based CAR.

Figure 17:
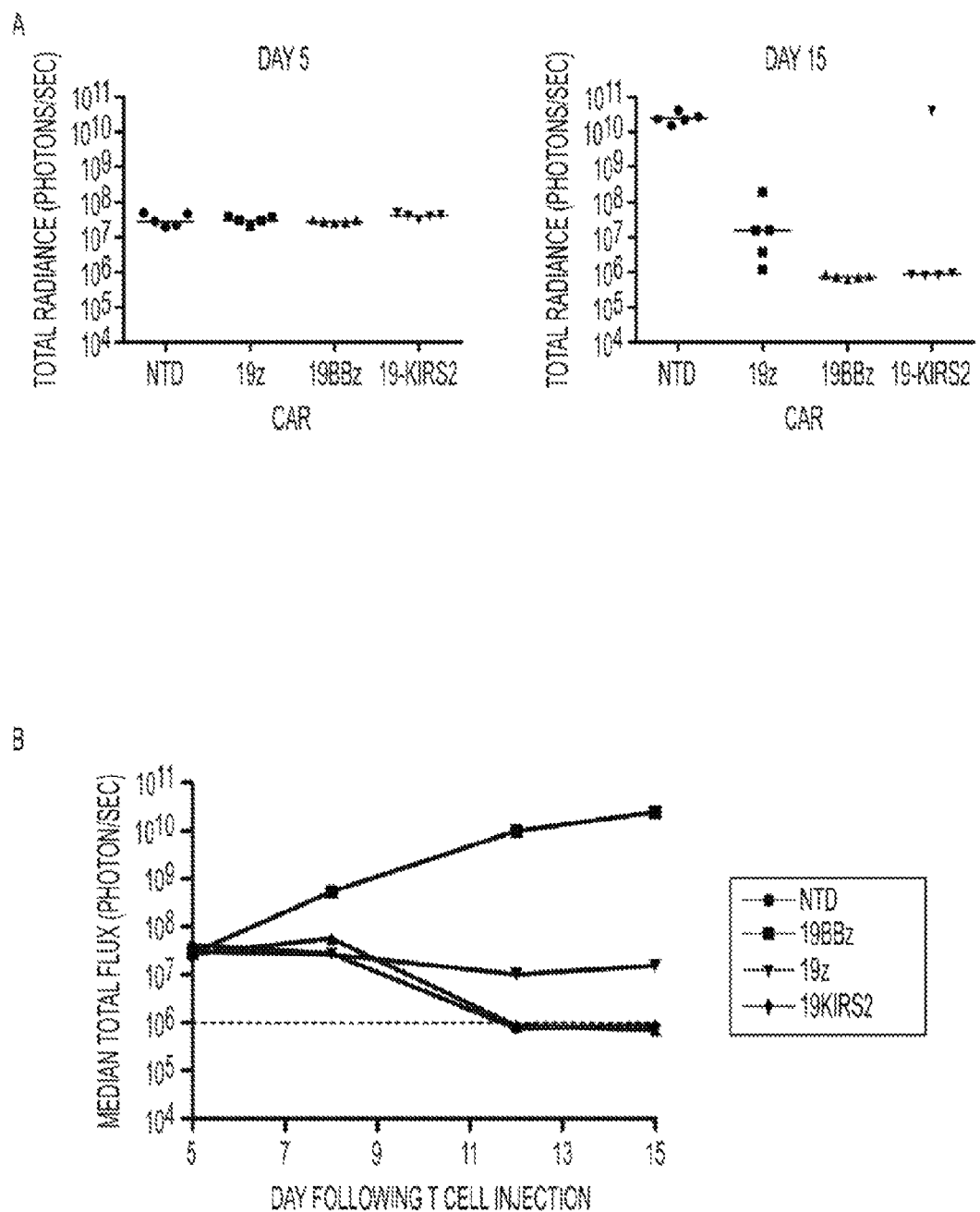
FIG. 17, comprising

T Cells Transduced with CD19-KIRS2/DAP12 Induce Tumor Regression in a Human Leukemia Xenograft Material and Method:

NOD-SCID-$\gamma_c^{-/-}$ (NSG) mice were engrafted intravenously by tail vein on day 0 with 1 million Nalm-6 CBG tumor cells, a leukemia cell line expressing CD19. In the experiment, T cells were stimulated with anti-CD3/anti-CD28 stimulator beads followed by lentiviral transduction on day 1 with a series of CD3-based CAR with or without a costimulatory domain (CD19-z, CD19-BBz) or the CD19-specific KIR-based CARs, CD19-KIRS2 with DAP12 as indicated in the figure. Mock transduced T cells (NTD) were used as a control. The T cells were expanded until the end of log-phase growth ex vivo and injected intravenously on day 5 post leukemia cell line injection with 2 million CAR T cells per mouse. Tumor burden was assessed via bioluminescent imaging. 5 animals were analyzed for each T cell condition (FIG. 17).

Result:

In the in vivo experiment presented (FIG. 17), the NTD T cells had no effect on tumor growth, while CD19z, CD19BBz and CD19-KIRS2-transduced T cells exhibit various anti-tumor effects. Mice infused with CD19z T cells showed a slight reduction in tumor burden but retained detectable levels of luminescence. In contrast, tumor cell luminescence in mice infused with either CD19BBz or CD19KIRS2 T cells dropped to the lower limit of detection (FIG. 17B, dotted line) only 7 days post T cell injection, exhibiting complete clearance outside of a small reservoir of leukemia cells in the T cell-inaccessible tooth root. By day 15, tumor burden in the mock T cell group surpassed the endpoint ($2 \times 10^{10}$ photons/second) and were sacrificed, while luminescence in the CD19BBz and CD19KIRS2 groups remained at the lower limit of detection.

Example 9: A Camelid Single VHH Domain-Based CAR can be Expressed on a T Cell Surface in Combination with a scFv-Based CAR without Appreciable Receptor Interaction Material and Method:

Jurkat T cells expressing GFP under an NFAT-dependent promoter (NF-GFP) were transduced with either a mesothelin-specific activating CAR (SS1-CAR), CD19-specific activating (19-CAR) or a CAR generated using a camelid VHH domain specific to EGFR (VHH-CAR). Following transduction with the activating CAR, the cells were then transduced with an additional inhibitory CAR recognizing CD19 (19-PD1) to generate cells co-expressing both the activating and inhibitory CAR (SS1+19PD1, 19+19PD1 or VHH+19PD1). The transduced Jurkat T cells were co-cultured for 24 hours with different cell lines that are either 1) devoid of all target antigens (K562), 2) express mesothelin (K-meso), CD19 (K-19) or EGFR (A431) only, 3) express a combination of EGFR and mesothelin (A431-mesothelin) or CD19 (A431-CD19) or 4) express a combination of CD19 and mesothelin (K-19/meso). Additional conditions that include either no stimulator cells (no stim) or K562 with 1 µg/mL of OKT3 (OKT3) were also included as negative and positive controls for NFAT activation, respectively. GFP expression, as a marker of NFAT activation, was assessed by flow cytometry.

Figure 25:
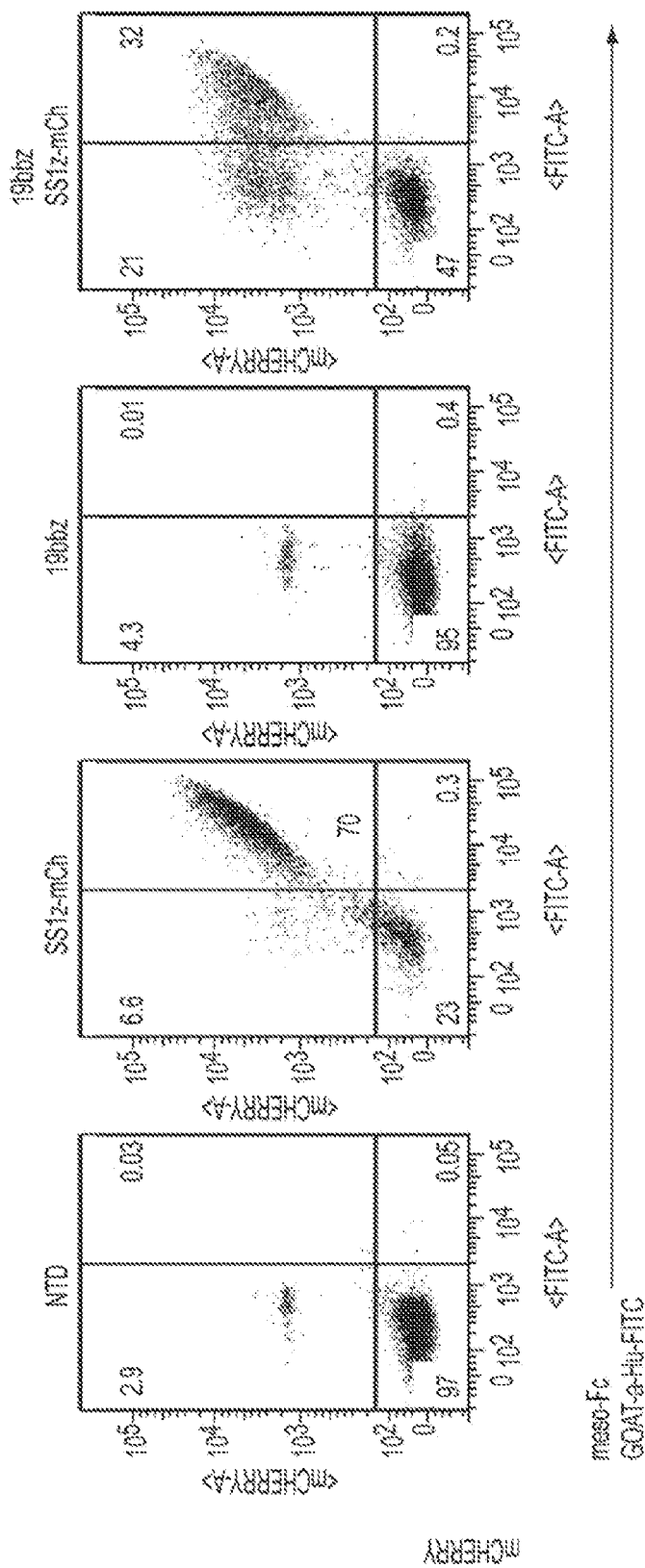
FIG. 25 is images demonstrating that expression of a CD19-specific CAR also reduced the expression of mesothelin-binding sites on the surface of cells co-expressing an SS1-zeta-mCherry fusion CAR. Primary human T cells were stimulated with CD3/28 microbeads followed by lentiviral transduction with an SS1 scFv zeta CAR bearing a C-terminal mCherry fusion (SS1z-mCh) or the FMC63-derived CD19 specific 41BB-zeta CAR (19bbz) alone or combination. Mock-transduced cells were used as a control. The T cells were expanded until the end of log-phase growth, and dsRed as well as surface CAR expression was determined by flow cytometry after staining with mesothelin-Fc followed by a goat-anti-human Fc specific polyclonal antibody conjugated to FITC.
Figure 26:
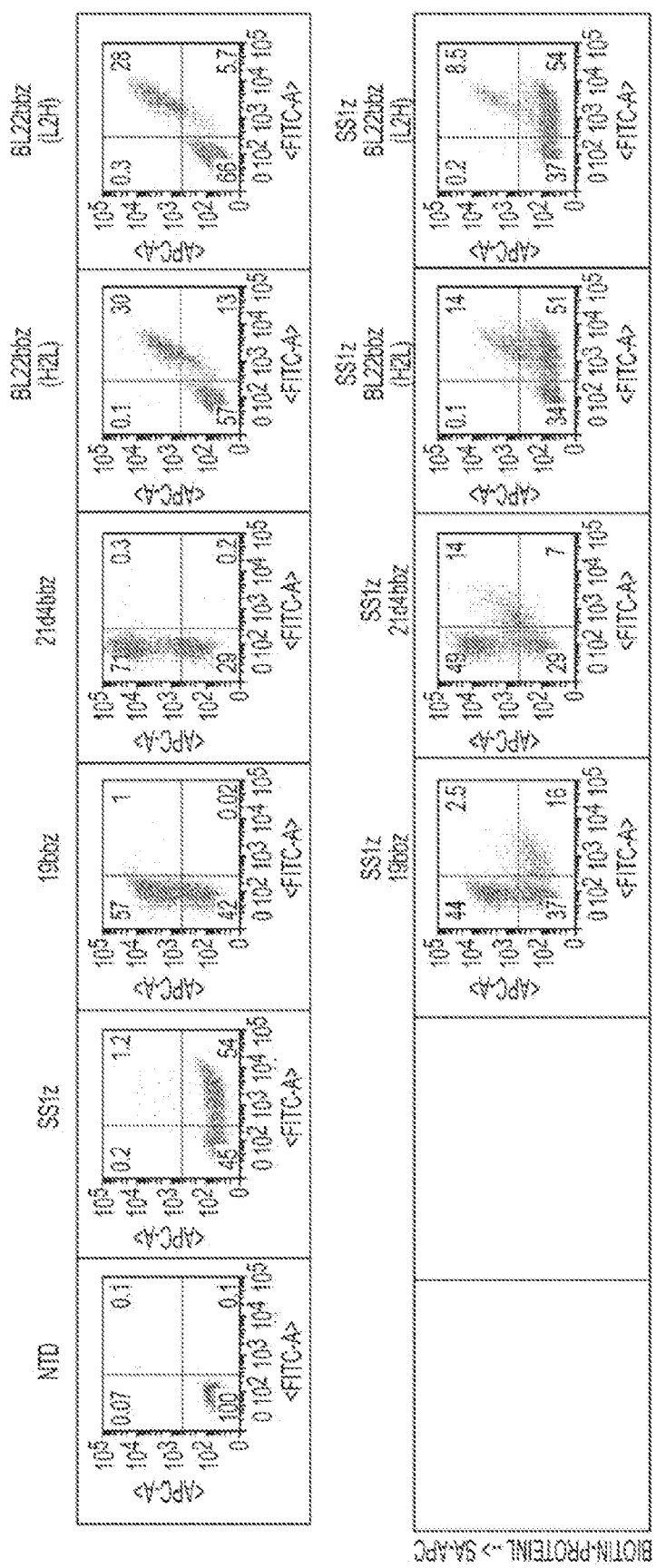
FIG. 26 is images demonstrating that mutually exclusive expression of binding sites for the SS1 scFv is not unique to the FMC63 scFv. Primary human T cells were stimulated with CD3/28 microbeads followed by lentiviral transduction with either an SS1 scFv zeta CAR or various CD19 specific 41BB-zeta CARs (19BBz [FMC63 scFv, 214d scFv or the BL22 scFv CARs with alternate VH and VL orientations [H2L and L2H]). NTD represents mock-transduced cells used as a staining control. In addition, a separate set of T cells were co-transduced with the SS1 scFv zeta CAR and the different CD19 specific CARs as above. The T cells were expanded until the end of log phase growth, and surface CAR expression was determined by staining with biotinylated protein L (recognizes kappa light chain) followed by streptavidin APC simultaneously with mesothelin-Fc followed by a goat-anti-human Fc specific polyclonal antibody conjugated to PE. The cotransduced cells showed that the mutually exclusive expression observed with FMC63-based CAR is also observed with other scFv-CARs.
Figure 27:
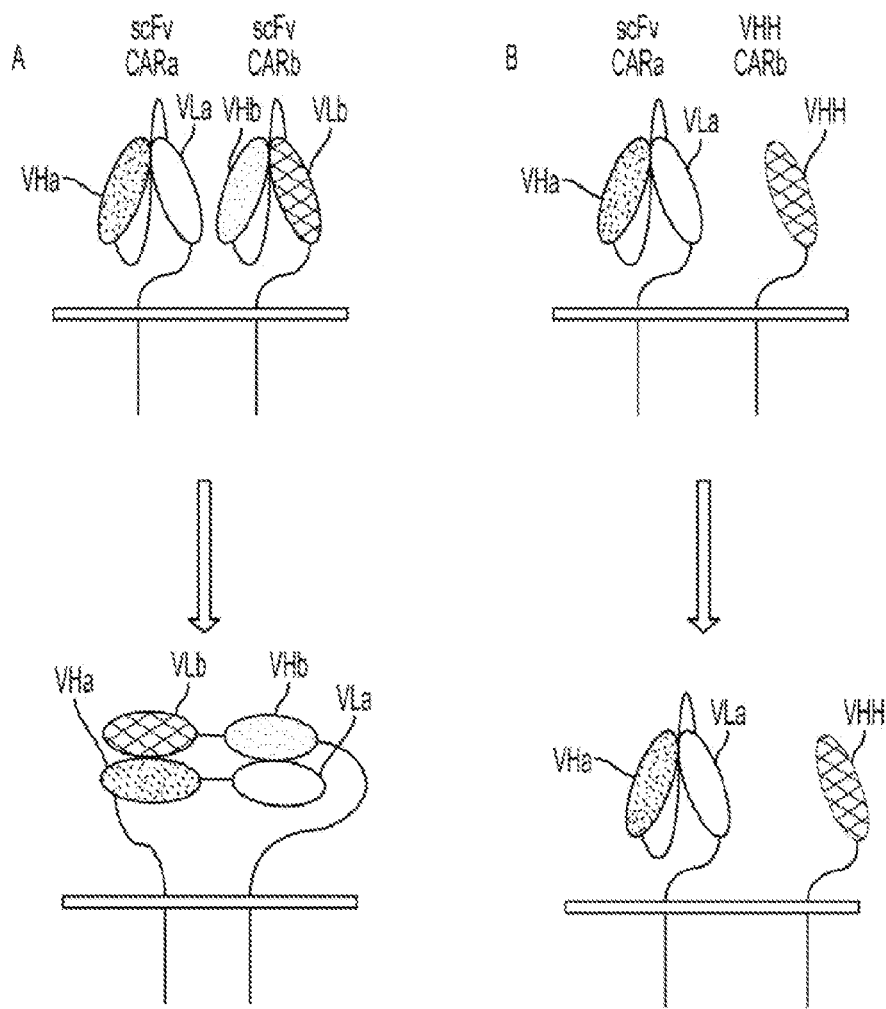
FIG. 27, comprising

Result:

Camels and related species (e.g. Llama) naturally produce antibodies that have a single heavy-chain like variable domain. This domain, known as a camelid VHH domain, has evolved to exist without pairing to a light chain variable domain. FIG. 27A shows schematically the possibility that two heterologous scFv molecules can dissociate and re-associate with one another when displayed on the surface of a cell as demonstrated by the observed disruption in scFv binding to cognate ligand during receptor co-expression (FIG. 25 and FIG. 26). FIG. 27B shows a schematic representation of the expected reduced interaction between a scFv CAR displayed on the surface of a cell in combination with a VHH domain-based CAR. FIG. 28 demonstrates that coexpression of two scFv-based CARs (SS1-z activating CAR and CD19-PD1 inhibitory CAR) on the surface of a Jurkat leads to the inability of the activating CAR (SS1-z) to recognize its cognate ligand on the target cell and trigger T cell activation despite the absence of the inhibitory receptor's ligand. This is consistent with the observed reduced ligand binding on the surface (FIG. 25). In contrast, the coexpression of the same inhibitory CAR (CD19-PD1) with a camelid VHH-based activating CAR (VHH-z) has no impact on the ability of the VHH-based activating CAR to recognize its cognate EGFR ligand. These data support the model depicted in FIG. 27B that a VHH-based activating CAR can be expressed with an scFv-based CAR without significant interaction between the receptors due to the reduced ability of the scFv and VHH domains to interact.

Figure 18:
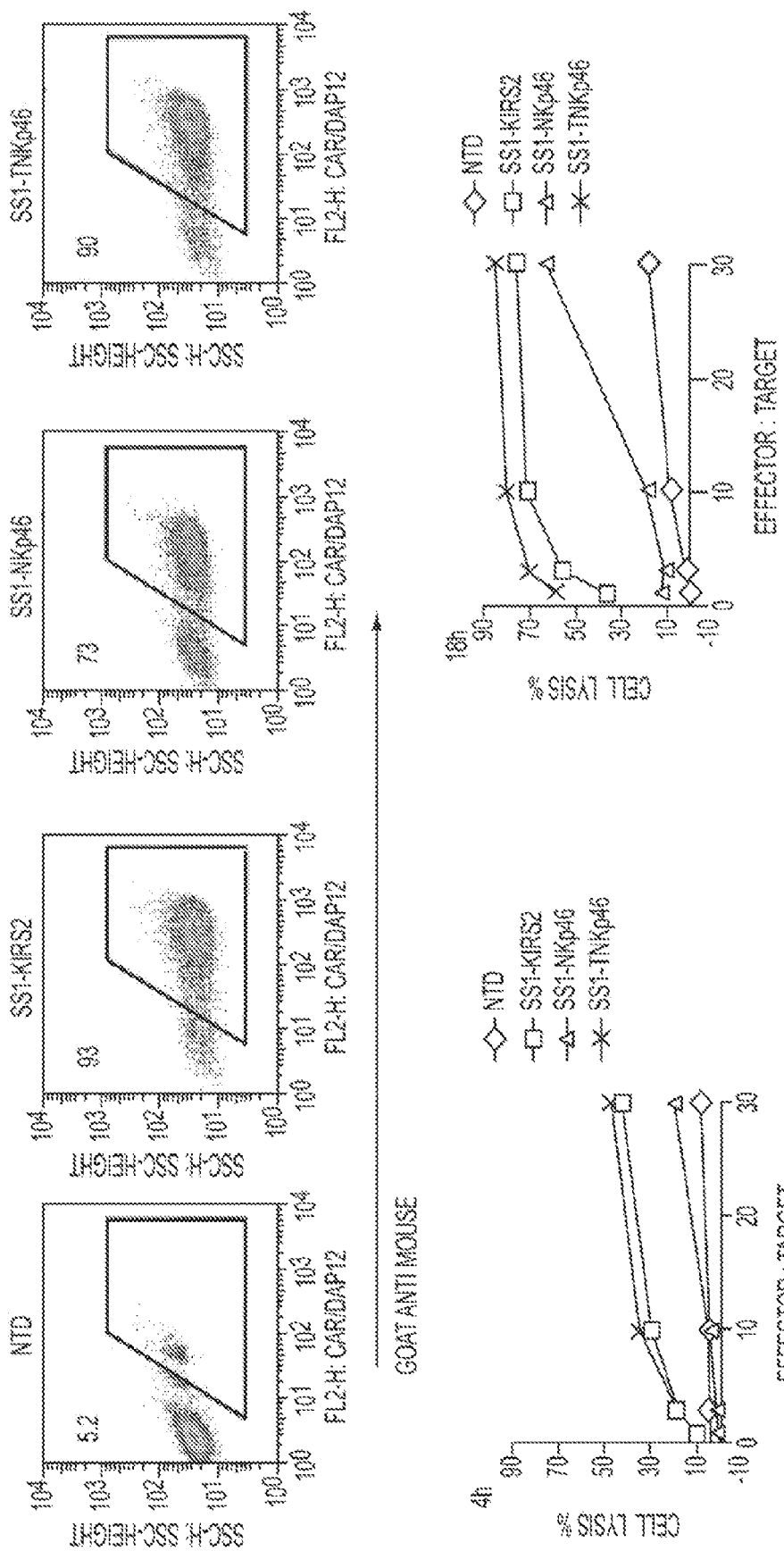
FIG. 18 demonstrates an NKp46-based NCR CAR with mesothelin specificity triggers antigen specific cytotoxicity. Following anti-CD3/anti-CD28 bead activation, T cells were transduced with a bi-cistronic lentiviral vector expressing either DAP12 and SS1-KIRS2 (control), or FcεRγ and a mesothelin specific NKp46-based CAR (SS1-NKp46) or FcεRγ and a mesothelin-specific NKp46 CAR in which the natural NKp46 extracellular domain was truncated (SS1-TNKp46). The expression of the mesothelin-specific CARs was assessed by flow cytometry using a biotinylated goat-anti-mouse F(ab)2 polyclonal antibody followed by SA-PE as shown in FIG. 18A. The T cells were mixed with $^{51}$Cr-labeled K562 target cells expressing mesothelin at varying ratios of effector T cells to target K562 cells (E:T ratio). Cytotoxicity was determined by measuring the fraction of $^{51}$Cr released into the supernatant at 4 hours compared with spontaneous release as shown in FIG. 18B.

Example 10: An NKp46-Based NCR CAR with Mesothelin Specificity Triggers Antigen Specific Cytotoxicity Material and Method:

Following anti-CD3/anti-CD28 bead activation, T cells were transduced with a bi-cistronic lentiviral vector expressing either DAP12 and SS1-KIRS2 (control), or FcεRγ and a mesothelin specific NKp46-based CAR (SS1-NKp46) or FcεRγ and a mesothelin-specific NKp46 CAR in which the natural NKp46 extracellular domain was truncated (SS1-TNKp46). The expression of the mesothelian-specific CARs was assessed by flow cytometry using a biotinylated goat-anti-mouse F(ab)2 polyclonal antibody followed by SA-PE (FIG. 18). The T cells were mixed with $^{51}$Cr-labeled K562 target cells expressing mesothelin at varying ratios of effector T cells to target K562 cells (E:T ratio). Cytotoxicity was determined by measuring the fraction of $^{51}$Cr released into the supernatant at 4 hours compared with spontaneous release.

Result:

Both the SS1-NKp46 and SS1-NKp46 receptors exhibit surface expression on T cells. SS1-NKp46 transduced T cells show robust target cell cytolysis that is comparable to the KIR-based SS1-KIRS2 CAR. SS1-NKp46 exhibited weaker cytotoxic activity that was evident only at high effector to target cell ratios (FIG. 18). These data demonstrate that an antigen-specific chimeric immunoreceptor for use in redirecting T cell cytolytic activity can be generated from natural cytotoxicity receptors (NCRs) using a design similar to that used to create a KIR-based CAR.

Example 11: Interaction of scFv Domains

Figure 23:
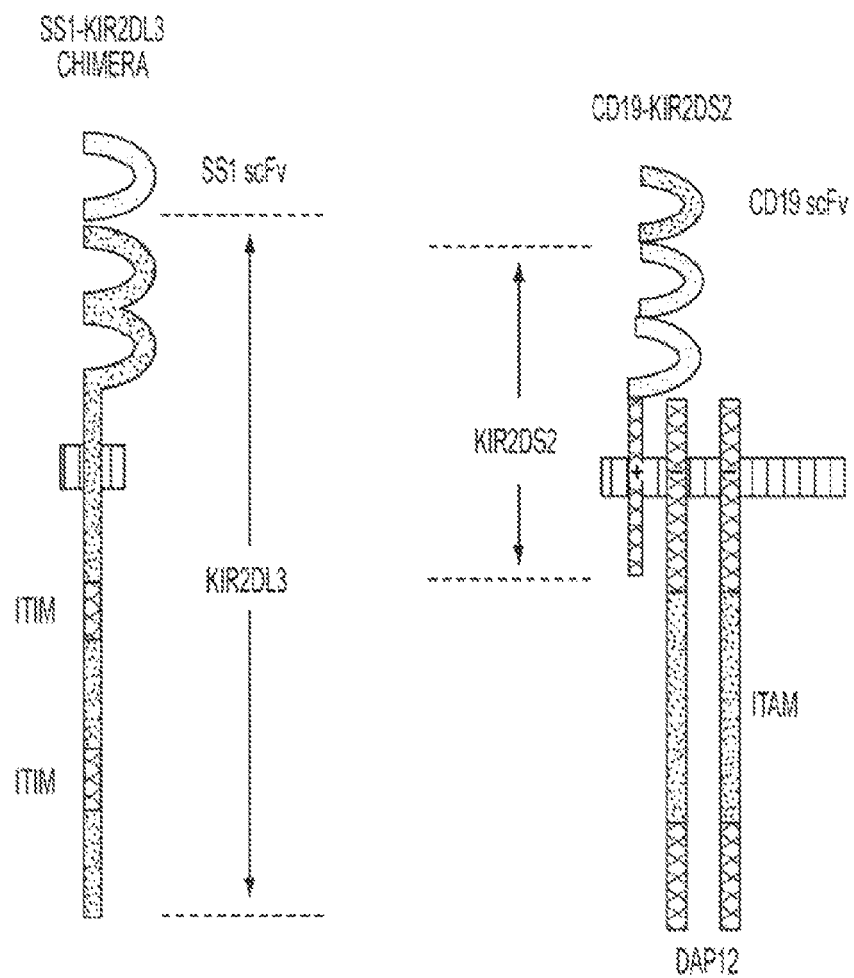
FIG. 23 shows a schematic representation of the receptors used in Experiments shown in FIG. 24.
Figure 24:
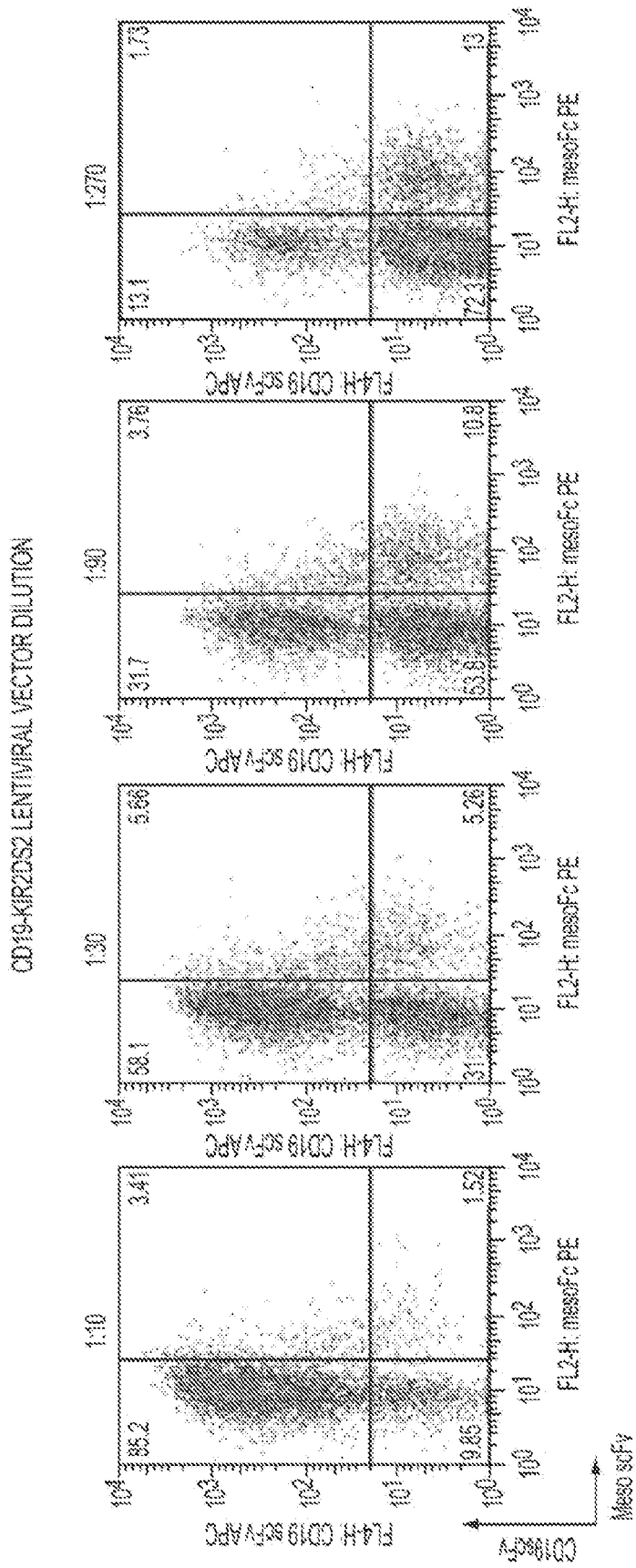
FIG. 24 demonstrates the inability to co-express two scFv-based chimeric receptors on the surface of the T cell while retaining each receptors' respective binding specificity. Jurkat T cells were transduced using a lentiviral vector encoding SS1-KIR2DL3. These cells were subsequently transduced with a second lentiviral vector encoding CD19-KIR2DS2 at varying dilutions of the vector. The expression of the SS1-specific scFv was assessed using mesothelin-Fc followed by PE-conjugated goat-anti-human Fc. The CD19-specific scFv expression was assessed using a PE-conjugated monoclonal antibody specific to the FMC63 idiotype.

Material and Method:

In FIG. 24, Jurkat T cells were transduced with lentiviral vector encoding a mesothelin-specific inhibitory KIR-based CAR (SS1-KIR2DL3). These transduced cells were then transduced with varying dilutions of a lentiviral vector encoding a CD19-specific activating KIR-based CAR (CD19-KIR2DS2). These KIR-CARs are shown schematically in FIG. 23. Following transduction with both CARs, the frequency of cells with surface expression of a CAR with an intact scFv capable of binding their target ligand was assessed by flow cytometry following staining with both a mesothelin-Fc fusion protein followed by a secondary anti-Fc antibody labeled with PE and an anti-CD19-specific (clone FMC63) anti-idiotype monoclonal antibody labeled with APC. In FIG. 25, anti-CD3/28-activated primary human T cells were transduced with different lentiviral vectors encoding either a mesothelin-specific CD3z-based CAR bearing an mCherry fusion to the C-terminus (SS1z-mCh), a CD19-specific CAR with CD3z and 4-1BB cytoplasmic domain (19bbz) or a combination of both SS1z-mCh and 19bbz. The expression of mCherry and a functional SS1 scFv was assessed by flow cytometry following staining with a mesothelin-Fc fusion protein followed by a secondary anti-Fc antibody labeled with FITC. In FIG. 26, anti-CD3/28-activated primary human T cells were transduced with different lentiviral vectors encoding either a mesothelin-specific CD3z-based CAR (SS1z), a CD19-specific CAR bearing the FMC63 scFv (19bbz) or a CD19-specific CAR bearing the 21d4 scFv (21d4bbz) or a CD19-specific CAR bearing the BL22 scFv (BL22bbz) in which the scFv was composed of either a heavy chain variable domain (VH) 5' to the light chain variable domain (VL) in the scFv (H2L) or the VL located 5' to the VH (L2H). Following transduction with each of the CD19-specific CAR, the T cells were then co-transduced with SS1z. The binding of the SS1z to mesothelin and the surface expression of the anti-CD19 scFv was assessed by flow cytometry following staining with a mesothelin-Fc fusion protein followed by a secondary anti-Fc antibody labeled with FITC or biotinylated protein L followed by streptavidin-conjugated APC.

Result:

FIG. 24 shows that coexpression of two intact, ligand-binding scFv-based CARs (SS1-KIR2DL3 and CD19-KIR2DS2) on the cell surface is mutually exclusive. FIG. 26 demonstrates the loss of ligand binding occurs despite expression of the CAR in the cell as illustrated by the presence of mCherry expressing cells with reduced mesothelin binding in cells co-transduced with SS1z-mCh and 19bbz. FIG. 26 demonstrates that the interaction between scFv leading to loss of scFv binding function can be observed using different scFv-based CARs supporting the universal nature of this effect. These observations are consistent with the model depicted in FIG. 27 Panel A in which the variable domain of one scFv can undergo intermolecular pairing with a heterologous scFv-based chimeric receptor leading to loss of binding by the scFv within a single CAR.

Example 12: A Chimeric Antigen Receptor (CARs) Based Upon a Killer Immunoglobulin-Like Receptor (KIR) Triggers Cytotoxic Activity in Solid Tumors Chimeric antigen receptors (CARs) based upon a single chimeric molecule bearing an antigen binding domain linked in cis to the cytoplasmic domains of CD3ζ and costimulatory receptors CD28 or 4-1BB provide a potent method for engineering T cell cytotoxicity towards tumors. A chimeric multichain receptor based upon a killer immunoglobulin-like receptors (KIRs) normally expressed by natural killer (NK) cells and T cells was used. Constructed by fusing a single chain variable fragment (scFv) to the transmembrane and cytoplasmic domain of a KIR, it was shown that a KIR-based CAR targeting mesothelin (SS1-KIR) triggers antigen-specific cytotoxic activity and cytokine production that is comparable to CD3ζ-based CARs with antigen-induced proliferation that is independent of additional costimulation. Using a xenograft model of mesothelioma resistant to T cell immunotherapy, it was further demonstrate that a KIR-based CAR targeting mesothelin exhibits more potent anti-tumor activity compared with T cells bearing mesothelin-specific CD3ζ-based CARs with costimulation despite in vivo persistence of the latter CAR-modified T cells. Evaluation of tumor infiltrating lymphocytes demonstrate that KIR-based CAR+ T cells show resistance to acquired hypofunction within the tumor microenvironment compared with CD3ζ-based CARs with costimulatory receptor domains. The ability of a KIR-based CAR to induce regression of a tumor in which second generation CD3ζ-based CARs show limited activity supports the future clinical evaluation of a KIR-based CAR in mesothelioma and other tumors, e.g., other solid tumors.

Example 13: In Vivo Anti-Tumor Activity of Mesothelin-Specific CARs

Figure 39:
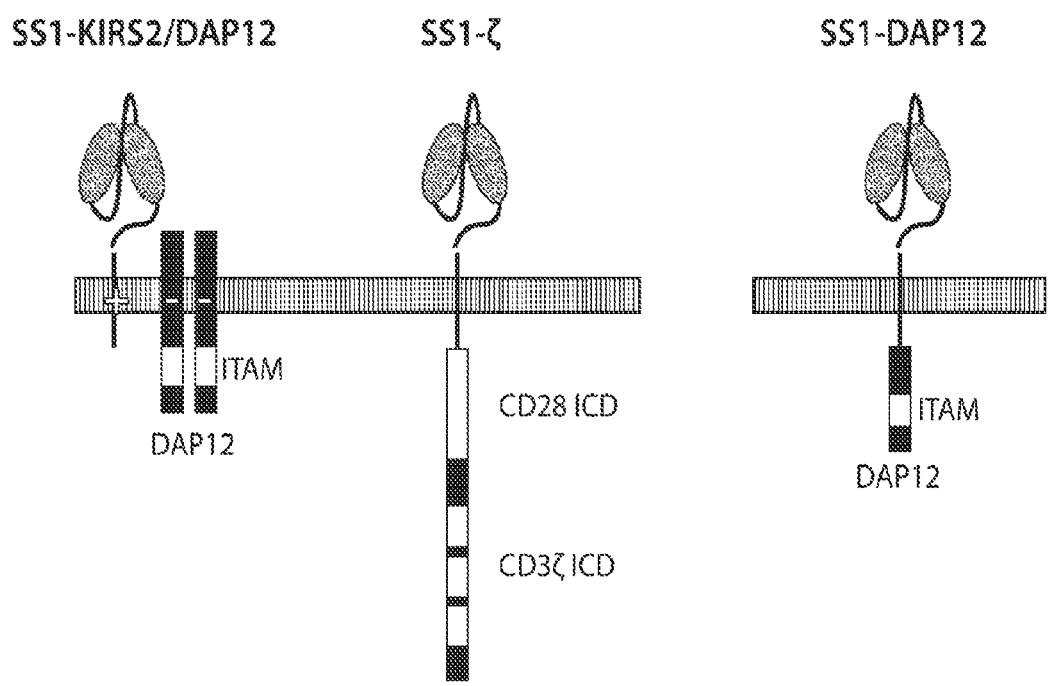
FIG. 39, comprising

Similar to the in xenograft experiment described in Example 6, a series of mesothelin-based CAR constructs were tested in a model of mesothelioma to assess in vivo anti-tumor activity. Three mesothelin-specific CAR constructs were tested (as shown in FIG. 39): a $2^{nd}$ generation CAR construct containing SS1 antigen binding domain and a cytoplasmic domain containing CD28 and CD3zeta intracellular signaling domains (SS1-28ζ, FIG. 39C), a multichain KIR-CAR comprising SS1 antigen binding domain and a KIR2DS2 cytoplasmic domain on one chain, and adaptor molecule DAP12 on another chain (SS1-KIRS2/DAP12, FIG. 39A), and a single chain KIR-CAR containing SS1 antigen binding domain and a cytoplasmic domain containing DAP12 (SS1-DAP12, FIG. 39B). The transmembrane domain of the SS1-DAP12 construct used was a CD8 transmembrane domain.

Adult NSG mice were injected subcutaneously with $2\times10^6$ EM-meso cells as described previously, and in Example 6. Primary human T cells were transduced with SS1-28ζ, SS1-KIRS2/DAP12, SS1-DAP12, achieving 90% transduction efficiency, or were mock transduced. $4.3\times10^6$ of the CAR-transduced or mock-transduced primary human T cells were injected intravenously on day 20 following tumor implantation. Tumor volume was measured by caliper using the formula $(\pi/6)\times(length)\times(width)^2$ at the indicated times (n=5 mice per group). Tumor volume was compared across CAR T cell treatment groups at day 40 (nadir of tumor regression) and day 52 (end of the experiment) by a one-way ANOVA ($p<0.001$) with between-group comparisons performed by a post-hoc Scheffe F-test. * indicates statistically different from the mock control at both time points ($p<0.001$).

Figure 40:
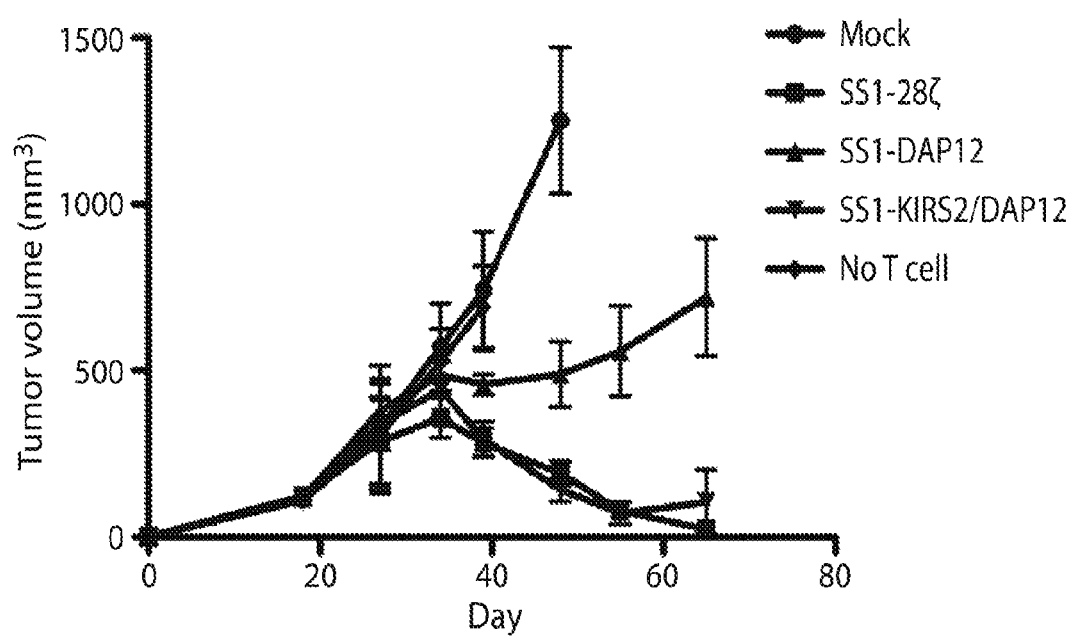
FIG. 40 shows in vivo anti-tumor activity of mesothelin-based CAR constructs, including the multi-chain KIRS/DAP12 and single chain DAP12 constructs.

As shown in FIG. 40, SS1-DAP12 showed anti-tumor activity, resulting in reduction in tumor volume compared to mock transduced and no T cell controls. SS1-KIRS2/DAP12, similar to the results described in Example 6, showed robust anti-tumor activity equivalent to that achieved by the SS1-28ζ construct.

Example 14: In Vitro Activity of NKR-CARs Containing Human Antigen Binding Domains that Bind Mesothelin NKR-CARs containing human antigen binding domains that bind to mesothelin were generated. The human scFv sequences that bind to mesothelin, M-5, M-11, M-12, M-14, M-16, M-17, M-21 and M-23, as provided in Table 4, were fused to a transmembrane domain and a cytoplasmic domain derived from KIR2DS2, hereafter referred to as huMeso-KIRS2. Lentiviral constructs were generated as described in previous examples, e.g., a bicistronic lentiviral vector further comprising the DAP12, linked to the NKR-CAR by the peptide cleavage site T2A. Various in vitro assays were performed to assess the CAR activity of the mesothelin-specific NKR-CARs containing human anti-mesothelin scFvs.

Surface Expression

Figures 1, 41:
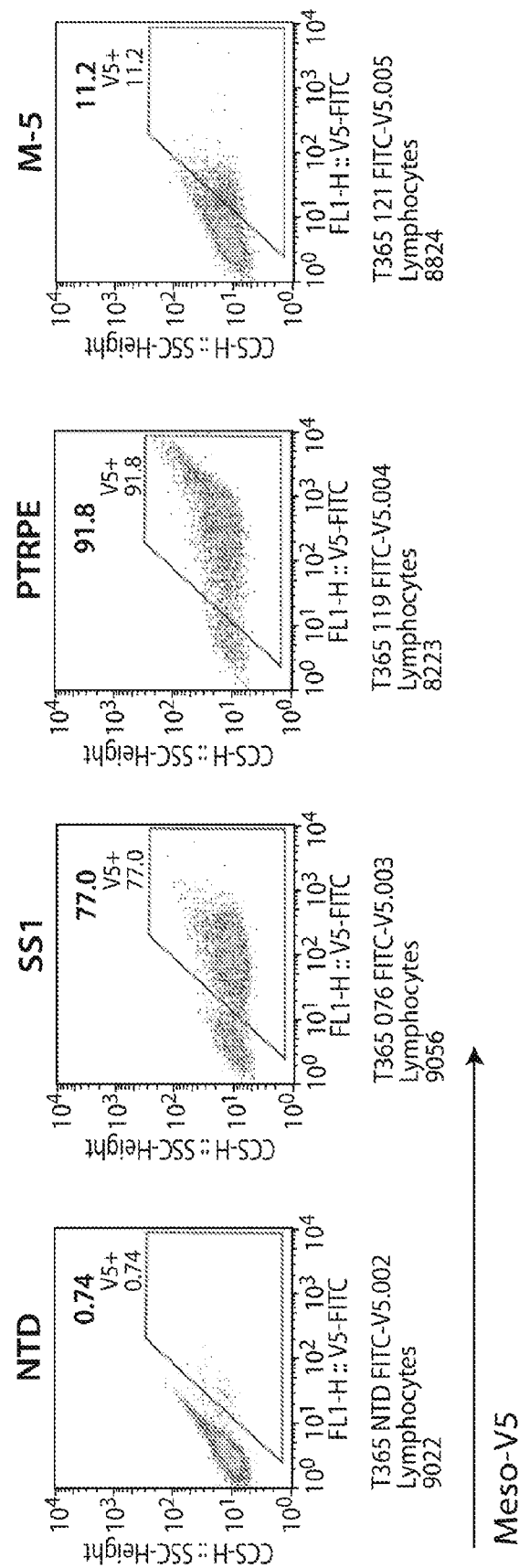
FIG. 41 shows the surface expression of mesothelin-based KIR-CAR on human primary T cells as detected by flow cytometry analysis.
Figures 2, 41:
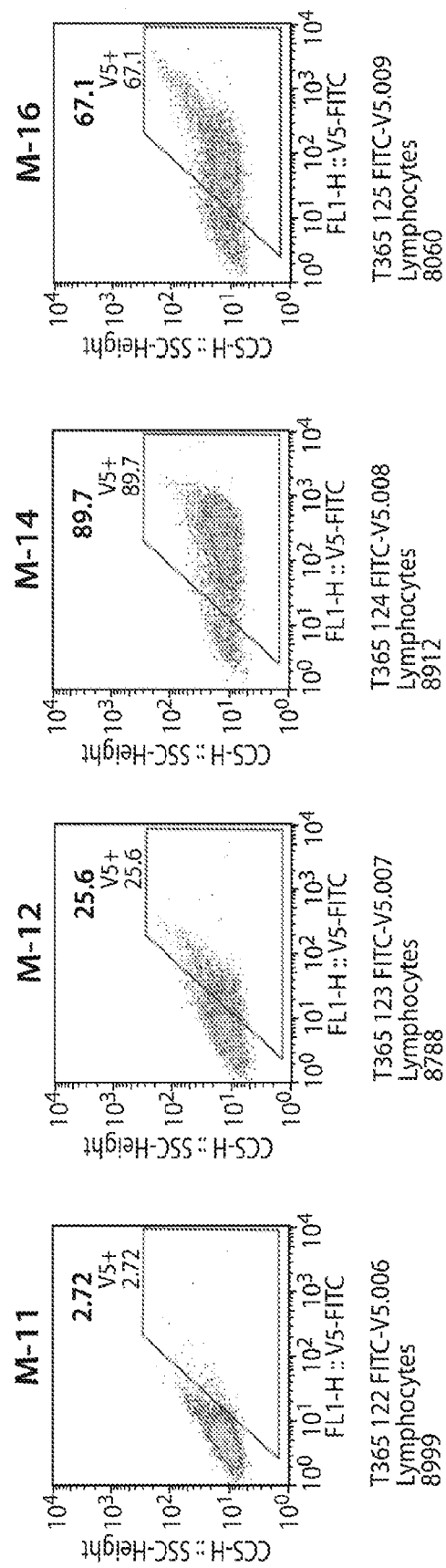
Figures 3, 41:
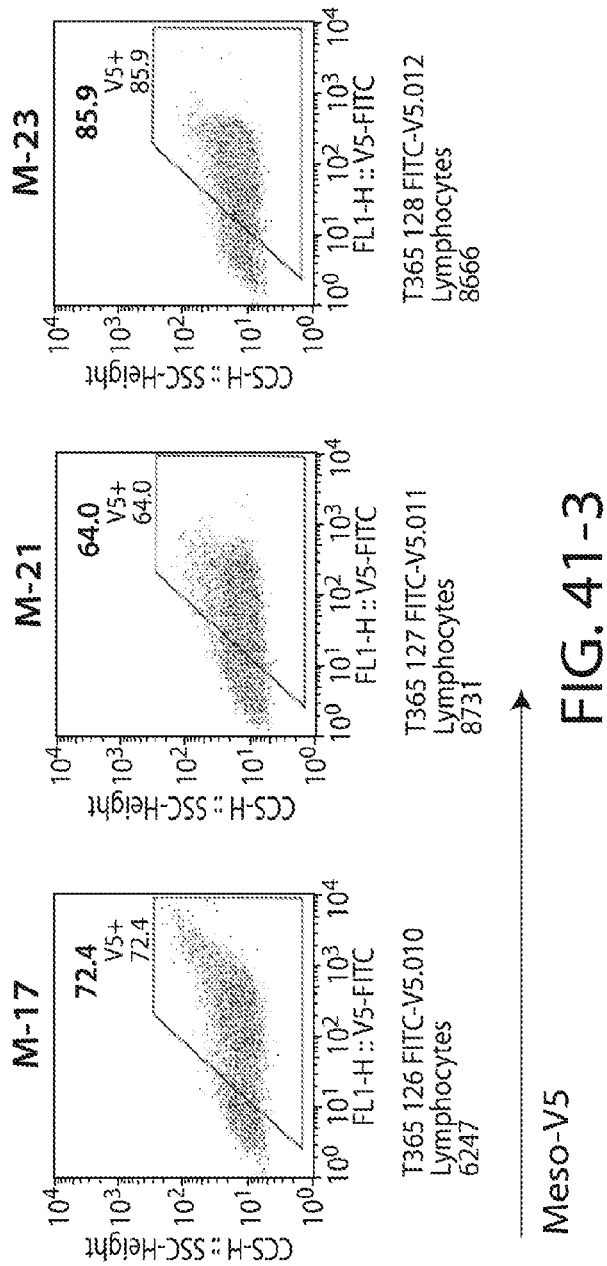
Figures 4, 41:
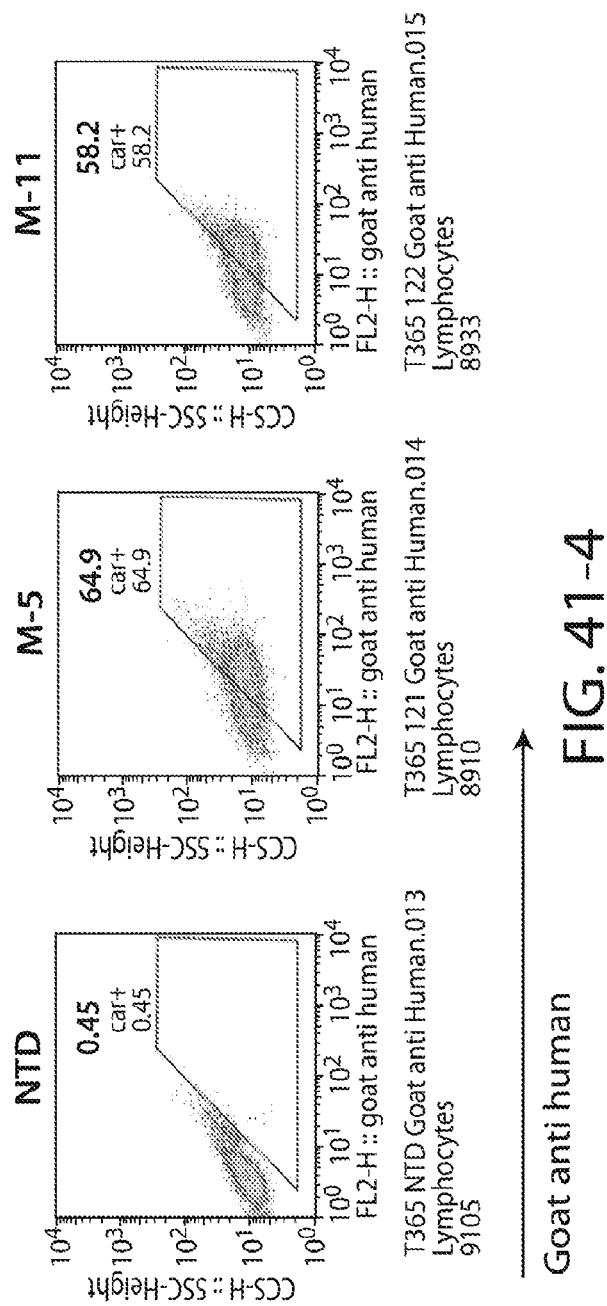
Figures 5, 41:
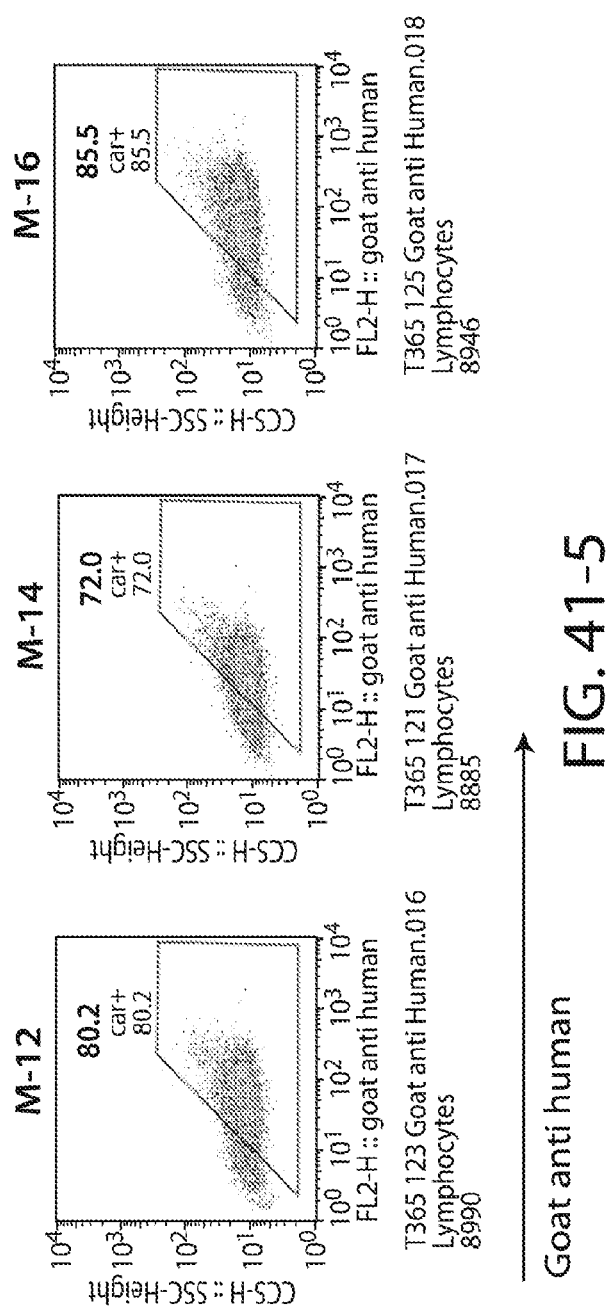
Figures 6, 41:
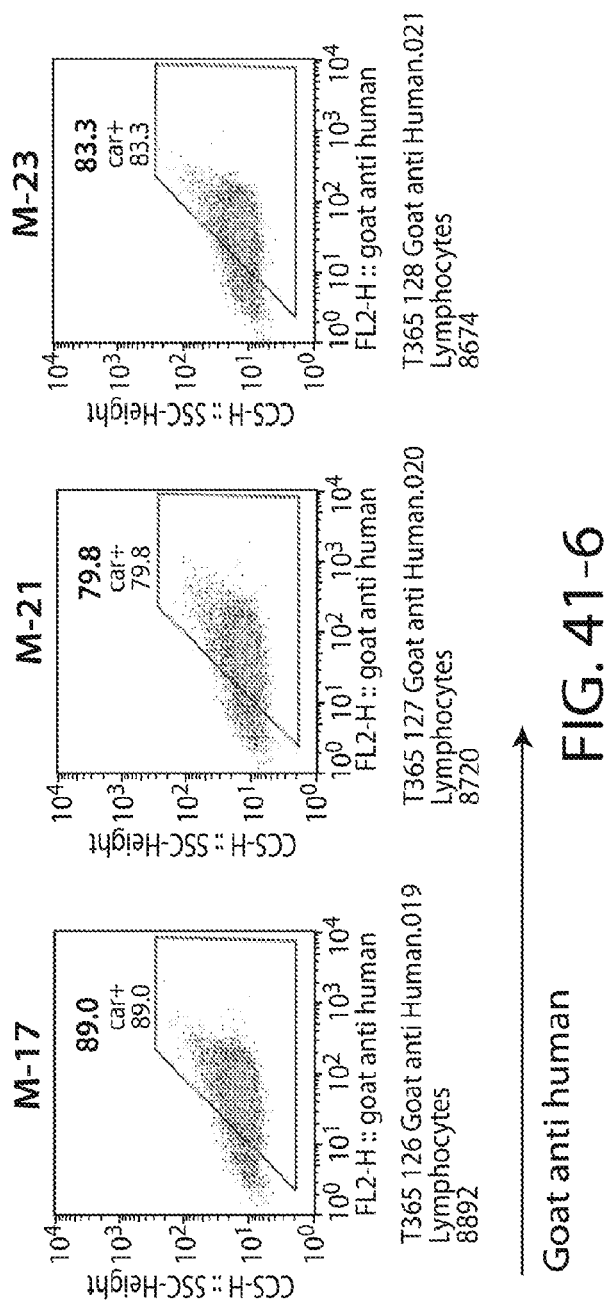

An assay was performed to determine the surface expression of the huMeso-KIRS2 constructs on primary human T cells. Primary human T cells were simulated with anti-CD3/anti-CD28 T cell activator beads (Dynabeads® CD3/CD28 CTS™, Life Technologies). After 24 hrs of stimulation, the T cells were transduced with a lentiviral vector encoding the huMeso-KIRS2 CARs: M-5, M-11, M-12, M-14, M-16, M-17, M-21, and M23, or controls SS1-PLENS and SS1-PTRPE. Cells were expanded for 7-8 days, and analyzed by flow cytometry for the expression of the indicated CAR using soluble mesothelin-V5-Hisx12 followed by FITC-conjugated antibody to the V5 epitope, or biotinylated goat anti human antibody followed by PE-conjugated SA. Surface expression of the huMeso-KIRS2 constructs was quantified by flow cytometry analysis, as shown in FIG. 41. The huMeso-KIRS2 constructs demonstrated expression on the surface of the primary human T cells.

Cytotoxicity

Target-specific cytotoxic activity of CAR cells expressing huMeso-KIRS2 was also assayed. Primary human T cells expressing huMeso-KIRS2 were mixed with $^{51}$Cr-labeled mesothelin-expressing target cells (K562 cells engineered to express mesothelin, K562-meso) or control target cells that do not express mesothelin (K562 cells, K562) in varying ratios of effector T cells to target cells (0:1, 10:1, 20:1, and 30:1). Cytotoxicity was determined by measuring the fraction of $^{51}$Cr released into the supernatant after 4 hours. As expected in the control experiment with control cells that do not express mesothelin (K562), none of the CAR-expressing cells demonstrated a significant amount of cytotoxicity. In FIG. 42B, untransduced (NTD) cells did not demonstrate antigen-specific cytotoxicity. HuMeso-KIRS2 containing M-23 and M-12 scFvs demonstrated little antigen-specific cytotoxicity. However, huMeso-KIRS2 containing M-5, M-11, M-16, M-17, and M-21 demonstrated significant antigen-specific cytotoxicity at similar levels to that of SS1-containing controls.

Cytokine Production

Figure 43A:
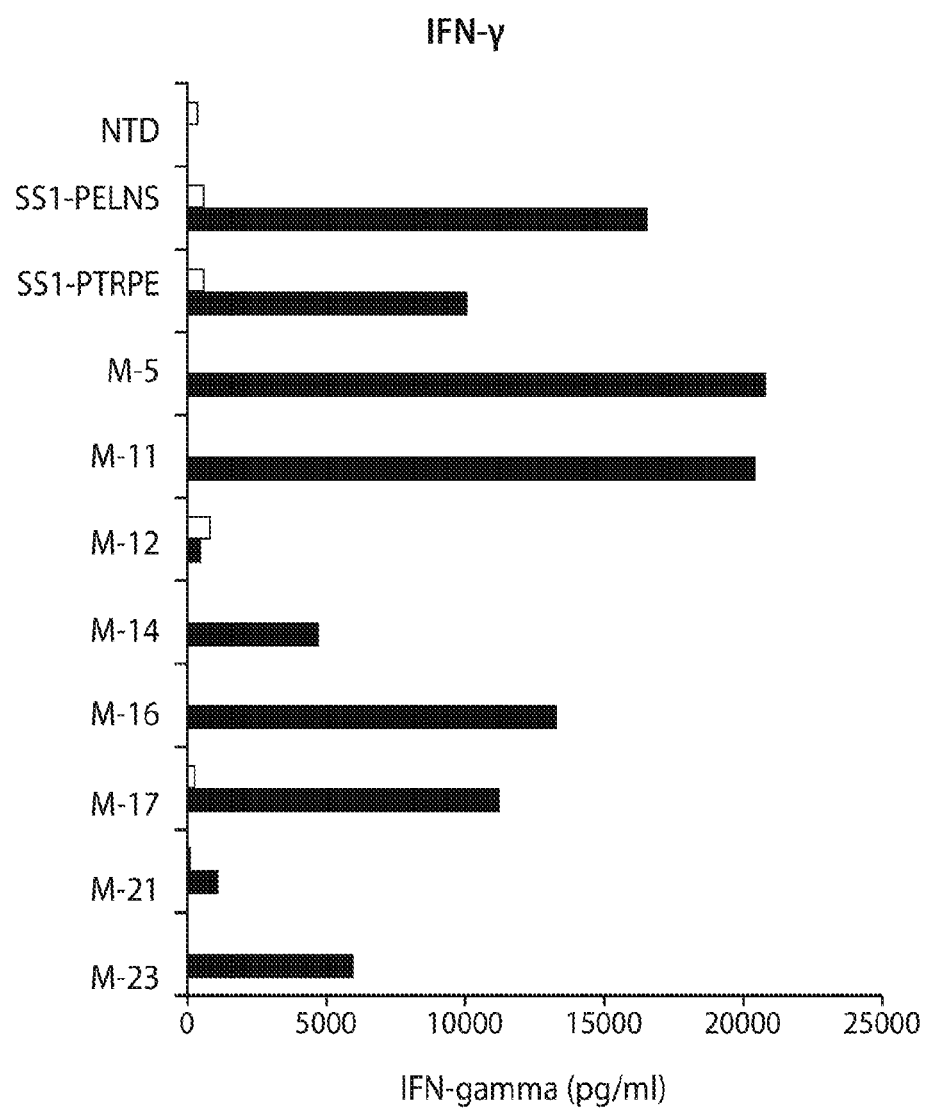
FIGS. 43A and 43B, shows the cytokine production of mesothelin-based KIR-CARs when cultured in the presence of mesothelin-expressing target cells (K562-meso, black bars) or control target cells that do not expressin mesothelin (K562, empty bars).
Figure 43B:
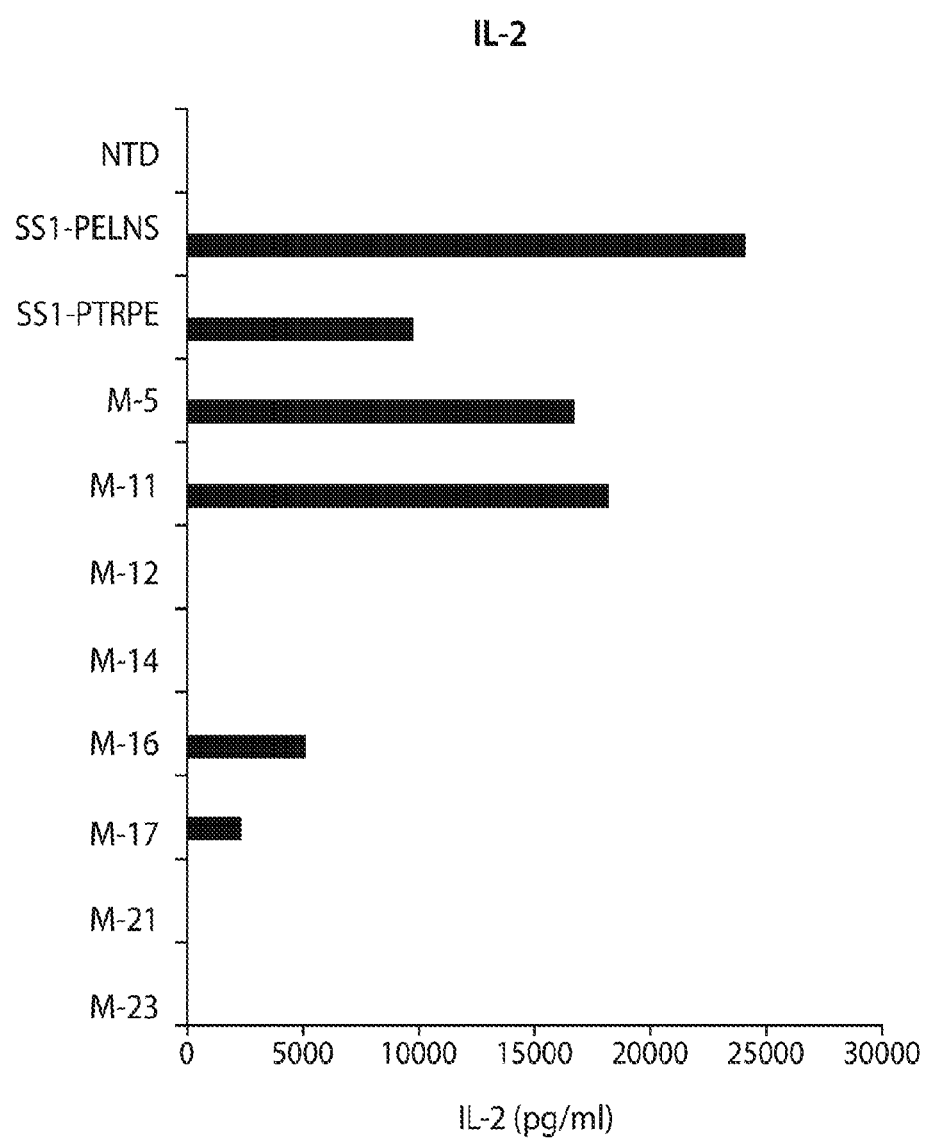
Figure 45:
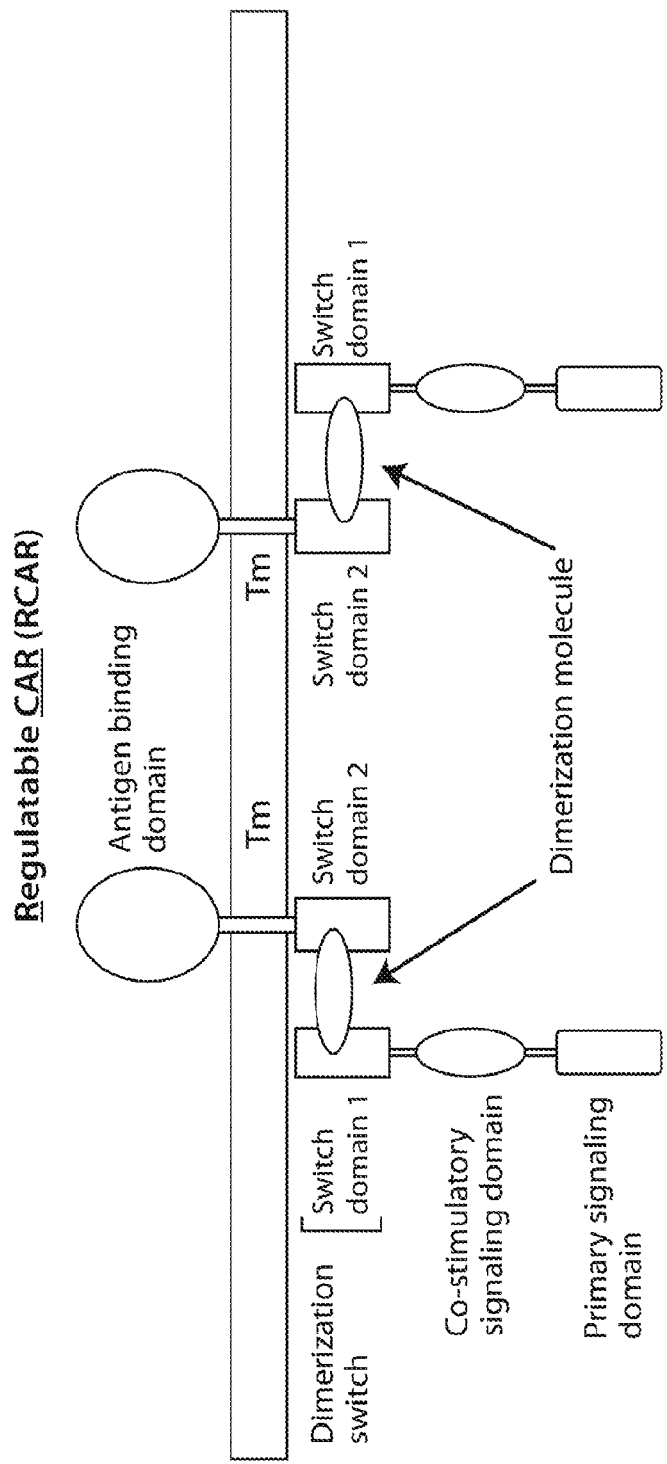
FIG. 45 depicts the structures of two exemplary RCAR configurations. The antigen binding members comprise an antigen binding domain, a transmembrane domain, and a switch domain. The intracellular binding members comprise a switch domain, a co-stimulatory signaling domain and a primary signaling domain. The two configurations demonstrate that the first and second switch domains described herein can be in different orientations with respect to the antigen binding member and the intracellular binding member. Other RCAR configurations are further described herein.
Figure 46:
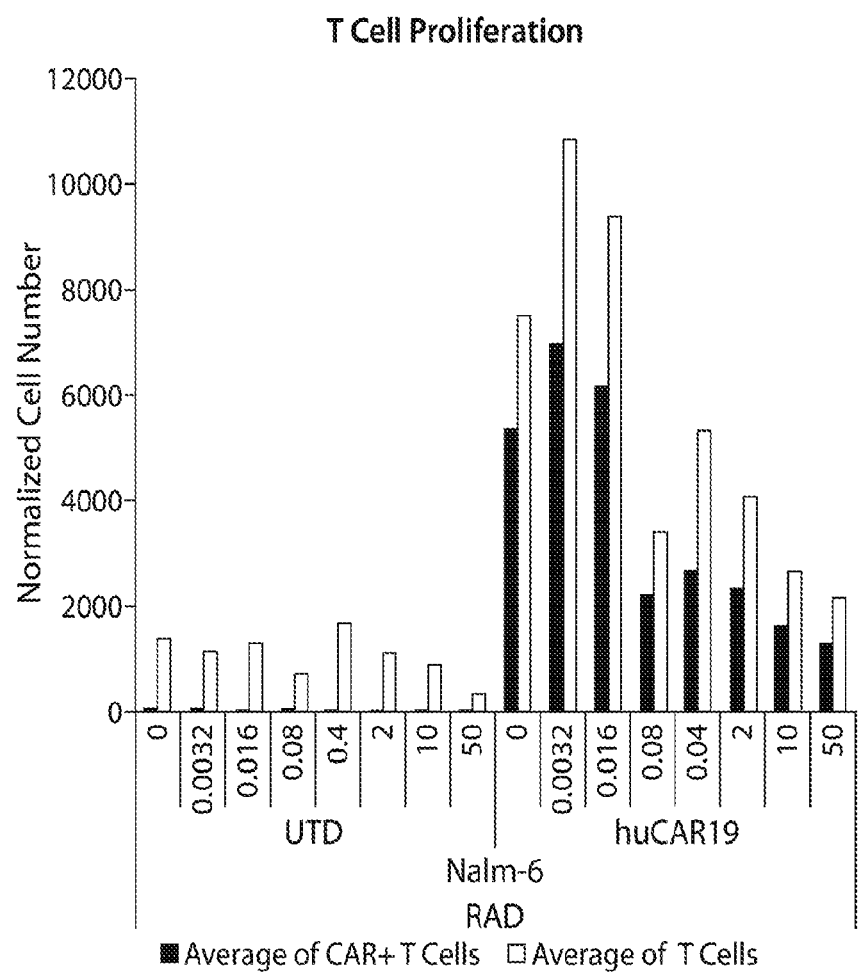
FIG. 46 shows that the proliferation of CAR-expressing, transduced T cells is enhanced by low doses of RAD001 in a cell culture system. CARTs were co-cultured with Nalm-6 cells in the presence of different concentrations of RAD001. The number of CAR-positive CD3-positive T cells (black) and total T cells (gray) was assessed after 4 days of co-culture.
Figure 47:
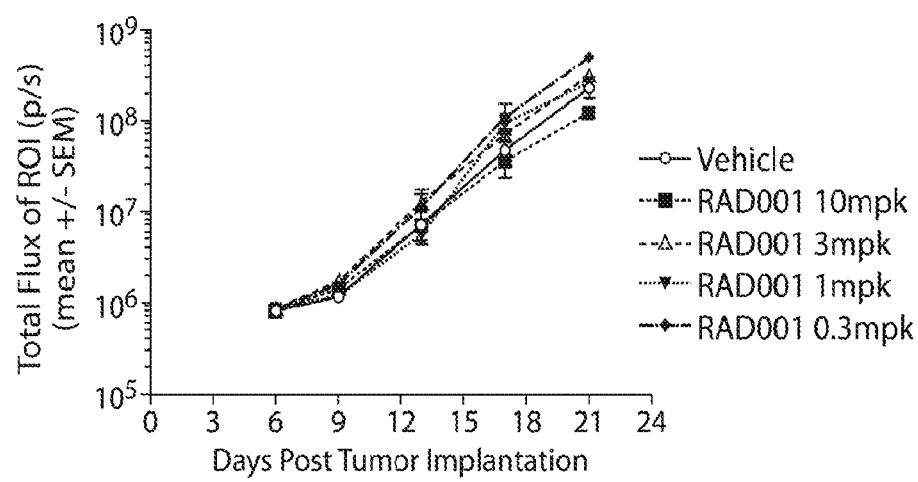
FIG. 47 depicts tumor growth measurements of NALM6-luc cells with daily RAD001 dosing at 0.3, 1, 3, and 10 mg/kg (mpk) or vehicle dosing. Circles denote the vehicle; squares denote the 10 mg/kg dose of RAD001; triangles denote the 3 mg/kg dose of RAD001, inverted triangles denote the 1 mg/kg dose of RAD001; and diamonds denote the 0.3 mg/kg dose of RAD001.
Figure 48A:
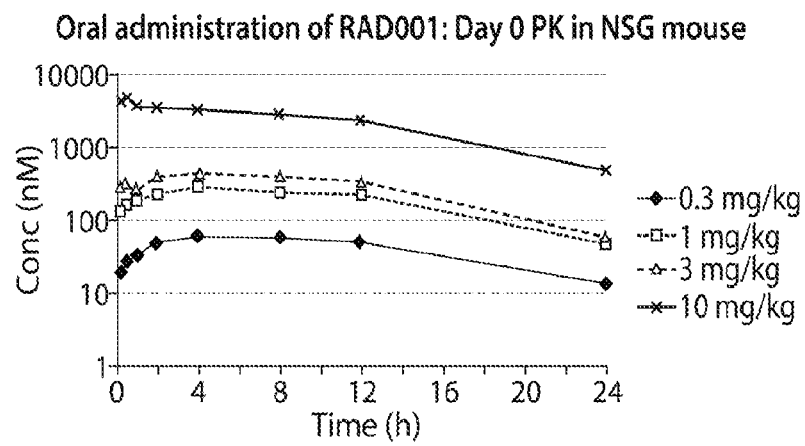
FIGS. 48A and 48B, shows pharmacokinetic curves showing the amount of RAD001 in the blood of NSG mice with NALM6 tumors.
Figure 48B:
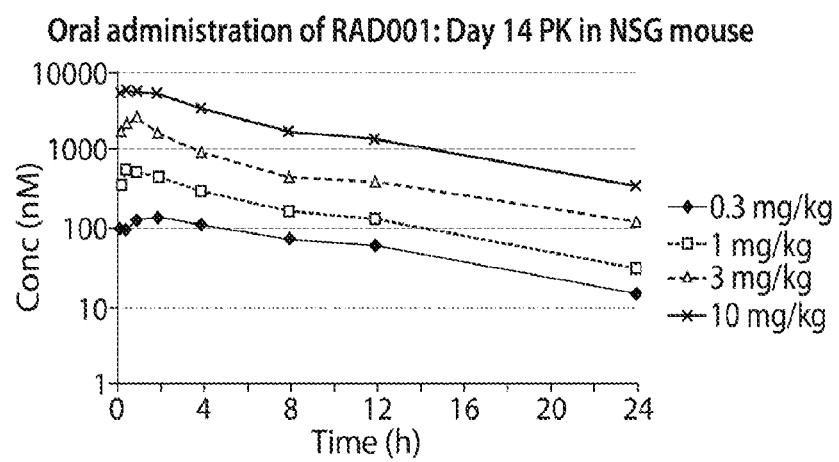
Figure 49A:
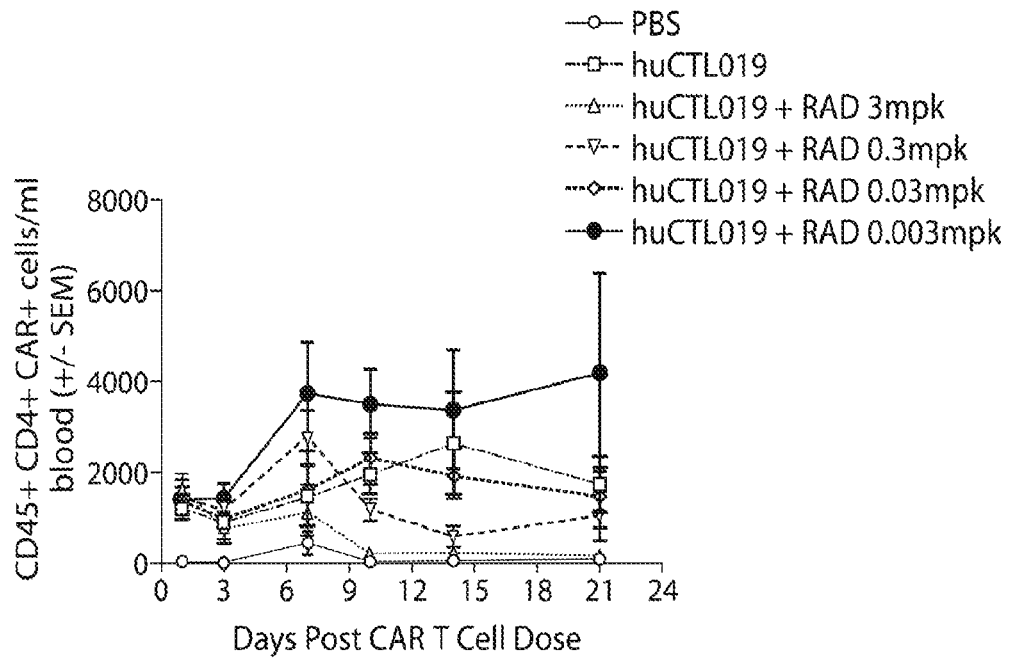
FIGS. 49A and 49B, shows in vivo proliferation of humanized CD19 CART cells with and without RAD001 dosing. Low doses of RAD001 (0.003 mg/kg) daily lead to an enhancement in CAR T cell proliferation, above the normal level of huCAR19 proliferation.
Figure 49B:
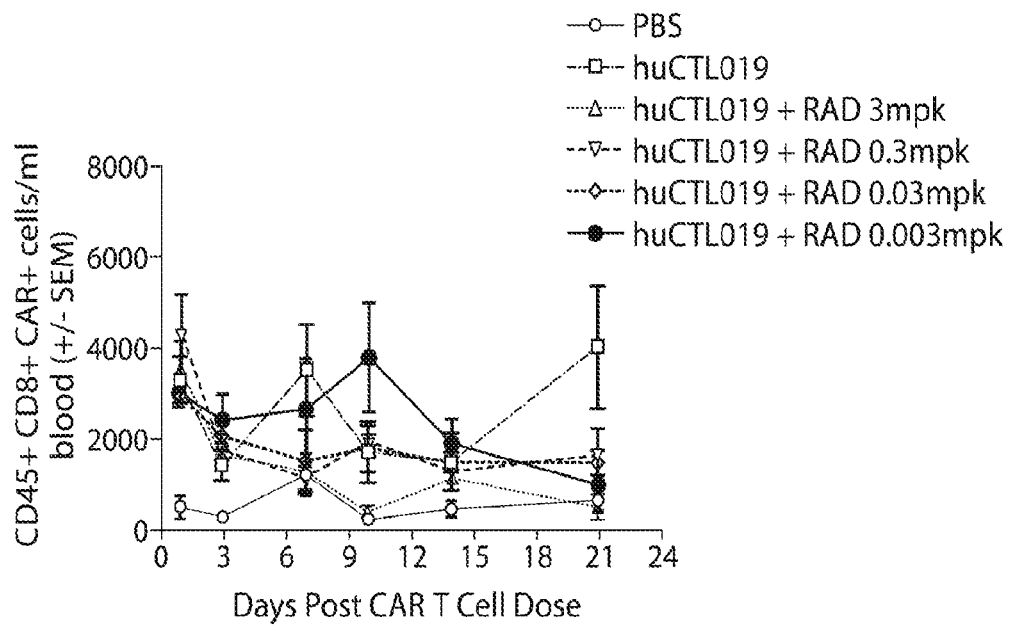

Cytokine production of the huMeso-KIRS2-expressing CAR cells was also assessed. Primary human T cells were simulated, transduced with the huMes-KIRS2 and expanded as previously described. Following expansion, the transduced T cells were mixed with K562 (mesothelin-negative cells, empty bars) or K562 cells engineered to express mesothelin (black bars) at a ratio of 2:1. Cytokine concentrations (IFNγ and IL-2) were determined in supernatants following 24 hours of stimulation by ELISA for the indicated cytokines. As shown in FIG. 43A, M-5, M-11, M-14, M-16, M-17, and M-23 containing huMeso-KIRS2-expressing CAR cells produced IFNγ. As shown in FIG. 43B, M-5, M-11, M16, and M17 containing huMes-KIRS2-expressing cells produced IL-2.

Example 15: Low Dose RAD001 Stimulates CART Proliferation in a Cell Culture Model The effect of low doses of RAD001 on CAR T cell proliferation in vitro was evaluated by co-culturing CART-expressing cells with target cells in the presence of different concentrations of RAD001.

Materials and Methods

Generation of CAR-Transduced T Cells

A humanized, anti-human CD19 CAR (huCART19) lentiviral transfer vector was used to produce the genomic material packaged into VSVg pseudotyped lentiviral particles. The amino acid and nucleotide sequence of the humanized anti-human CD19 CAR (huCART19) is CAR 1, ID 104875 described in PCT publication, WO2014/153270, filed Mar. 15, 2014, and is designated SEQ ID NOs. 85 and 31 therein.

Lentiviral transfer vector DNA is mixed with the three packaging components VSVg env, gag/pol and rev in combination with lipofectamine reagent to transfect Lenti-X 293T cells. Medium is changed after 24 h and 30 h thereafter, the virus-containing media is collected, filtered and stored at −80° C. CARTs are generated by transduction of fresh or frozen naïve T cells obtained by negative magnetic selection of healthy donor blood or leukopak. T cells are activated by incubation with anti-CD3/anti-CD28 beads for 24 h, after which viral supernatant or concentrated virus (MOI=2 or 10, respectively) is added to the cultures. The modified T cells are allowed to expand for about 10 days. The percentage of cells transduced (expressing the CARs on the cell surface) and the level of CAR expression (relative fluorescence intensity, Geo Mean) are determined by flow cytometric analysis between days 7 and 9. The combination of slowing growth rate and T cell size approaching ~350 fL determines the state for T cells to be cryopreserved for later analysis.

Evaluating Proliferation of CARTs

To evaluate the functionality of CARTs, the T cells are thawed and counted, and viability is assessed by Cellometer. The number of CAR-positive cells in each culture is normalized using non-transduced T cells (UTD). The impact of RAD001 on CARTs was tested in titrations with RAD001, starting at 50 nM. The target cell line used in all co-culture experiments is Nalm-6, a human pre-B cell acute lymphoblastic leukemia (ALL) cell line expressing CD19 and transduced to express luciferase.

For measuring the proliferation of CARTs, T cells are cultured with target cells at a ratio of 1:1. The assay is run for 4 days, when cells are stained for CD3, CD4, CD8 and CAR expression. The number of T cells is assessed by flow cytometry using counting beads as reference.

Results

The proliferative capacity of CART cells was tested in a 4 day co-culture assay. The number of CAR-positive CD3-positive T cells (dark bars) and total CD3-positive T cells (light bars) was assessed after culturing the CAR-transduced and non-transduced T cells with Nalm-6 (FIG. 39). huCART19 cells expanded when cultured in the presence of less than 0.016 nM of RAD001, and to a lesser extent at higher concentrations of the compound. Importantly, both at 0.0032 and 0.016 nM RAD001 the proliferation was higher than observed without the addition of RAD001. The non-transduced T cells (UTD) did not show detectable expansion.

Example 16: Low Dose RAD001 Stimulates CART Expansion In Vivo

This example evaluates the ability of huCAR19 cells to proliferate in vivo with different concentrations of RAD001.
Materials and Methods:
NALM6-luc Cells:

The NALM6 human acute lymphoblastic leukemia (ALL) cell line was developed from the peripheral blood of a patient with relapsed ALL. The cells were then tagged with firefly luciferase. These suspension cells grow in RPMI supplemented with 10% heat inactivated fetal bovine serum.

Mice:

6 week old NSG (NOD.Cg-Prkdc$^{scid}$Il2rg$^{tm/Wjl}$/SzJ) mice were received from the Jackson Laboratory (stock number 005557).

Tumor Implantation:

NALM6-luc cells were grown and expanded in vitro in RPMI supplemented with 10% heat inactivated fetal bovine serum. The cells were then transferred to a 15 ml conical tube and washed twice with cold sterile PBS. NALM6-luc cells were then counted and resuspended at a concentration of 10×10$^6$ cells per milliliter of PBS. The cells were placed on ice and immediately (within one hour) implanted in the mice. NALM6-luc cells were injected intravenously via the tail vein in a 100 µl volume, for a total of 1×10$^6$ cells per mouse.

CAR Tcell Dosing:

Mice were administered 5×10$^6$ CAR T cells 7 days after tumor implantation. Cells were partially thawed in a 37 degree Celsius water bath and then completely thawed by the addition of 1 ml of cold sterile PBS to the tube containing the cells. The thawed cells were transferred to a 15 ml falcon tube and adjusted to a final volume of 10 mls with PBS. The cells were washed twice at 1000 rpm for 10 minutes each time and then counted on a hemocytometer. T cells were then resuspended at a concentration of 50×10$^6$ CAR T cells per ml of cold PBS and kept on ice until the mice were dosed. The mice were injected intravenously via the tail vein with 100 µl of the CAR T cells for a dose of 5×10$^6$ CAR T cells per mouse. Eight mice per group were treated either with 100 µl of PBS alone (PBS), or humanized CD19 CAR T cells.

RAD001 Dosing:

A concentrated micro-emulsion of 50 mg equal to 1 mg RAD001 was formulated and then resuspended in D5W (dextrose 5% in water) at the time of dosing. Mice were orally dosed daily (via oral gavage) with 200 µl of the desired doses of RAD001.

PK Analysis:

Mice were dosed daily with RAD001 starting 7 days post tumor implantation. Dosing groups were as follows: 0.3 mg/kg, 1 mg/kg, 3 mg/kg, and 10 mg/kg. Mice were bled on days 0 and 14 following the first and last dose of RAD001, at the following time points for PK analysis: 15 minutes, 30 minutes, 1 hour, 2 hours, 4 hours, 8 hours, 12 hours, and 24 hours.

Results:

The expansion and pharmacokinetics of RAD001 was tested in NSG mice with NALM6-luc tumors. Daily oral dosing of RAD001 alone did not have an impact on the growth of NALM6-luc tumors (FIG. 40). The pharmacokinetic analysis of RAD001 shows that it is fairly stable in the blood of tumor bearing mice (FIGS. 41A and 41B). Both the day 0 and day 14 PK analyses show that the RAD001 concentrations in the blood is above 10 nm even 24 hours after dosing at the lowest dose tested (0.3 mg/kg).

Based on these doses, huCAR19 CAR T cells were dosed with and without RAD001 to determine the proliferative ability of these cells. The highest dose used was 3 mg/kg based on the levels of RAD001 in the blood 24 hours after dosing. As the concentration of RAD001 was above 10 nM 24 hours after the final dose of RAD001, several lower doses of RAD001 were used in the in vivo study with CAR T cells. The CAR T cells were dosed IV one day prior to the start of the daily oral RAD001 dosing. Mice were monitored via FACS for T cell expansion.

Figure 42A:
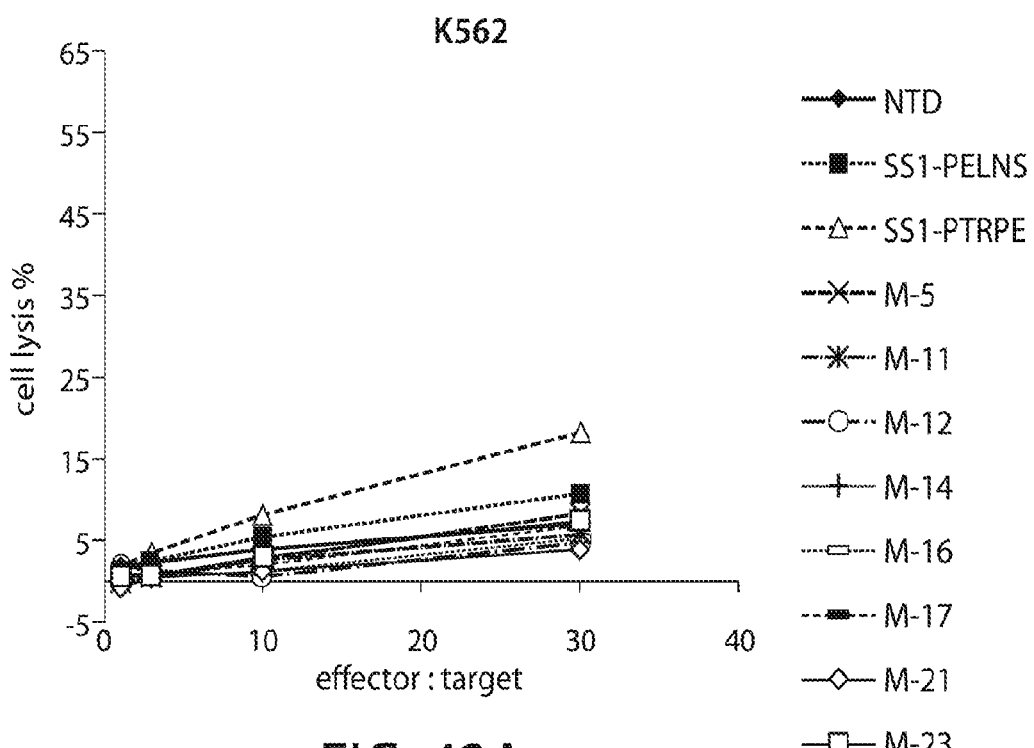
FIGS. 42A and 42B, shows the antigen-specific cytotoxic activity of mesothelin-based KIR-CARs for target cells that do not express mesothelin (K562) (FIG. 42A) or target cells engineered to express mesothelin (K562-meso) (FIG. 42B)
Figure 42B:
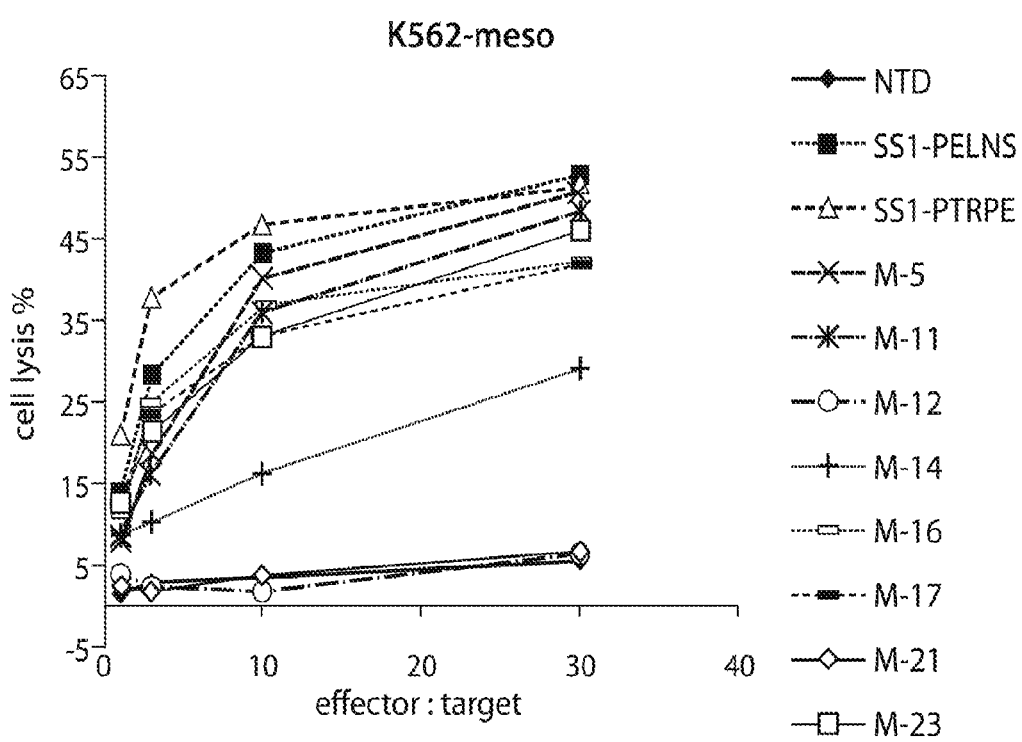

The lowest doses of RAD001 show an enhanced proliferation of the CAR T cells (FIG. 42). This enhanced proliferation is more evident and prolonged with the CD4+ CAR T cells than the CD8+ CAR T cells. However, with the CD8+ CAR T cells, enhanced proliferation can be seen at early time points following the CAR T cell dose. In embodiments, a RNA CART cell can also be used in combination with checkpoint inhibitors.

The disclosures of each and every patent, patent application, and publication cited herein are hereby incorporated herein by reference in their entirety. While this invention has been disclosed with reference to specific embodiments, it is apparent that other embodiments and variations of this invention may be devised by others skilled in the art without departing from the true spirit and scope of the invention. The appended claims are intended to be construed to include all such embodiments and equivalent variations.

SEQUENCE LISTING (372 sequences)

SEQ ID NO: 1 - protein, 21 aa, Artificial Sequence
  source: /note="Description of Artificial Sequence: Synthetic peptide"
MALPVTALLLPLALLLHAARP

SEQ ID NO: 2 - protein, 45 aa, Artificial Sequence
  source: /note="Description of Artificial Sequence: Synthetic polypeptide"
TTTPAPRPPTPAPTIASQPLSLRPEACRPAAGGAVHTRGLDFACD

SEQ ID NO: 3 - protein, 230 aa, Artificial Sequence
  source: /note="Description of Artificial Sequence: Synthetic polypeptide"
ESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKM

SEQ ID NO: 4 - protein, 282 aa, Artificial Sequence
  source: /note="Description of Artificial Sequence: Synthetic polypeptide"
RWPESPKAQASSVPTAQPQAEGSLAKATTAPATTRNTGRGGEEKKKEKEKEEQEERETKTPECPSHTQPLGVYLLTPAVQDLWLRDKATFTCFVVGSDLKDAHLTWEVAGKVPTGGVEEGLLERHSNGSQSQHSRLTLPRSLWNAGTSVTCTLNHPSLPPQRLMALREPAAQAPVKLSLNLLASSDPPEAASWLLCEVSGFSPPNILLMWLEDQREVNTSGFAPARPPPQPGSTTFWAWSVLRVPAPPSPQPATYTCVVSHEDSRTLLNASRSLEVSYVTDH

SEQ ID NO: 5 - protein, 10 aa, Artificial Sequence
  source: /note="Description of Artificial Sequence: Synthetic peptide"
GGGGSGGGGS

SEQ ID NO: 6 - protein, 24 aa, Artificial Sequence
  source: /note="Description of Artificial Sequence: Synthetic peptide"
IYIWAPLAGTCGVLLLSLVITLYC

SEQ ID NO: 7 - protein, 42 aa, Artificial Sequence
  source: /note="Description of Artificial Sequence: Synthetic polypeptide"
KRGRKKLLYIFKQPFMRPVQTTQEEDGCSCRFPEEEEGGCEL

SEQ ID NO: 8 - protein, 48 aa, Artificial Sequence
  source: /note="Description of Artificial Sequence: Synthetic polypeptide"
QRRKYRSNKGESPVEPAEPCRYSCPREEEGSTIPIQEDYRKPEPACSP

SEQ ID NO: 9 - protein, 112 aa, Artificial Sequence
  source: /note="Description of Artificial Sequence: Synthetic polypeptide"
RVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 10 - protein, 112 aa, Homo sapiens
RVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 11 - DNA, 1184 bp, Artificial Sequence
  source: /note="Description of Artificial Sequence: Synthetic polynucleotide"
cgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtga

SEQ ID NO: 12 - DNA, 63 bp, Artificial Sequence
  source: /note="Description of Artificial Sequence: Synthetic oligonucleotide"
atggccctgcctgtgacagccctgctgctgcctctggctctgctgctgcatgccgctagaccc

SEQ ID NO: 13 - DNA, 135 bp, Artificial Sequence
  source: /note="Description of Artificial Sequence: Synthetic polynucleotide"
accacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgat

SEQ ID NO: 14 - DNA, 690 bp, Artificial Sequence
  source: /note="Description of Artificial Sequence: Synthetic polynucleotide"
gagagcaagtacggccctccctgccccccttgccctgcccccgagttcctgggcggacccagcgtgttcctgttcccccccaagcccaaggacaccctgatgatcagccggacccccgaggtgacctgtgtggtggtggacgtgtcccaggaggaccccgaggtccagttcaactggtacgtggacggcgtggaggtgcacaacgccaagaccaagccccgggaggagcagttcaatagcacctaccgggtggtgtccgtgctgaccgtgctgcaccaggactggctgaacggcaaggaatacaagtgtaaggtgtccaacaagggcctgcccagcagcatcgagaaaaccatcagcaaggccaagggccagcctcgggagccccaggtgtacaccctgccccctagccaagaggagatgaccaagaaccaggtgtccctgacctgcctggtgaagggcttctaccccagcgacatcgccgtggagtgggagagcaacggccagcccgagaacaactacaagaccaccccccctgtgctggacagcgacggcagcttcttcctgtacagccggctgaccgtggacaagagccggtggcaggagggcaacgtctttagctgctccgtgatgcacgaggccctgcacaaccactacacccagaagagcctgagcctgtccctgggcaagatg

SEQ ID NO: 15 - DNA, 847 bp, Artificial Sequence
  source: /note="Description of Artificial Sequence: Synthetic polynucleotide"
aggtggcccgaaagtcccaaggcccaggcatctagtgttcctactgcacagccccaggcagaaggcagcctagccaaagctactactgcacctgccactacgcgcaatactggccgtggcggggaggagaagaaaaaggagaaagagaaagaagaacaggaagagagggagaccaagacccctgaatgtccatcccatacccagccgctgggcgtctatctcttgactcccgcagtacaggacttgtggcttagagataaggccacctttacatgtttcgtcgtgggctctgacctgaaggatgcccatttgacttgggaggttgccggaaaggtacccacagggggggttgaggaagggttgctggagcgccattccaatggctctcagagccagcactcaagactcacccttccgagatccctgtggaacgccgggacctctgtcacatgtactctaaatcatcctagcctgcccccacagcgtctgatggcccttagagagccagccgcccaggcaccagttaagcttagcctgaatctgctcgccagtagtgatcccccagaggccgccagctggctcttatgcgaagtgtccggctttagcccgcccaacatcttgctcatgtggctggaggaccagcgagaagtgaacaccagcggcttcgctccagcccggcccccaccccagccgggttctaccacattctgggcctggagtgtcttaagggtcccagcaccacctagcccccagccagccacatacacctgtgttgtgtcccatgaagatagcaggaccctgctaaatgcttctaggagtctggaggtttcctacgtgactgaccatt

SEQ ID NO: 16 - DNA, 30 bp, Artificial Sequence
  source: /note="Description of Artificial Sequence: Synthetic oligonucleotide"
ggtggcggaggttctggaggtggaggttcc

SEQ ID NO: 17 - DNA, 72 bp, Artificial Sequence
  source: /note="Description of Artificial Sequence: Synthetic oligonucleotide"
atctacatctgggcgcccttggccgggacttgtggggtccttctcctgtcactggttatcaccctttactgc

SEQ ID NO: 18 - DNA, 126 bp, Artificial Sequence
  source: /note="Description of Artificial Sequence: Synthetic polynucleotide"
aaacggggcagaaagaaactcctgtatatattcaaacaaccatttatgagaccagtacaaactactcaagaggaagatggctgtagctgccgatttccagaagaagaagaaggaggatgtgaactg

SEQ ID NO: 19 - DNA, 123 bp, Artificial Sequence
  source: /note="Description of Artificial Sequence: Synthetic polynucleotide"
aggagtaagaggagcaggctcctgcacagtgactacatgaacatgactccccgccgccccgggcccacccgcaagcattaccagccctatgccccaccacgcgacttcgcagcctatcgctcc

SEQ ID NO: 20 - DNA, 336 bp, Artificial Sequence
  source: /note="Description of Artificial Sequence: Synthetic polynucleotide"
agagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 21 - DNA, 336 bp, Homo sapiens
agagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 22 - protein, 373 aa, Artificial Sequence
  source: /note="Description of Artificial Sequence: Synthetic polypeptide"
PGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQTLVTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 23 - DNA, 1182 bp, Artificial Sequence
  source: /note="Description of Artificial Sequence: Synthetic polynucleotide"
atggccctccctgtcactgccctgcttctccccctcgcactcctgctccacgccgctagaccacccggatggtttctggactctccggatcgcccgtggaatcccccaaccttctcaccggcactcttggttgtgactgagggcgataatgcgaccttcacgtgctcgttctccaacacctccgaatcattcgtgctgaactggtaccgcatgagcccgtcaaaccagaccgacaagctcgccgcgtttccggaagatcggtcgcaaccgggacaggattgtcggttccgcgtgactcaactgccgaatggcagagacttccacatgagcgtggtccgcgctaggcgaaacgactccgggacctacctgtgcggagccatctcgctggcgcctaaggcccaaatcaaagagagcttgagggccgaactgagagtgaccgagcgcagagctgaggtgccaactgcacatccatccccatcgcctcggcctgcggggcagtttcagaccctggtcacgaccactccggcgccgcgcccaccgactccggccccaactatcgcgagccagcccctgtcgctgaggccggaagcatgccgccctgccgccggaggtgctgtgcatacccggggattggacttcgcatgcgacatctacatttgggctcctctcgccggaacttgtggcgtgctccttctgtccctggtcatcaccctgtactgcaagcggggtcggaaaaagcttctgtacattttcaagcagcccttcatgaggcccgtgcaaaccacccaggaggaggacggttgctcctgccggttccccgaagaggaagaaggaggttgcgagctgcgcgtgaagttctcccggagcgccgacgcccccgcctataagcagggccagaaccagctgtacaacgaactgaacctgggacggcgggaagagtacgatgtgctggacaagcggcgcggccgggaccccgaaatgggcgggaagcctagaagaaagaaccctcaggaaggcctgtataacgagctgcagaaggacaagatggccgaggcctactccgaaattgggatgaagggagagcggcggaggggaaaggggcacgacggcctgtaccaaggactgtccaccgccaccaaggacacatacgatgccctgcacatgcaggcccttccccctcgc

SEQ ID NO: 24 - protein, 394 aa, Artificial Sequence
  source: /note="Description of Artificial Sequence: Synthetic polypeptide"
MALPVTALLLPLALLLHAARPPGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQTLVTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 25 - protein, 5 aa, Artificial Sequence
  source: /note="Description of Artificial Sequence: Synthetic peptide"
GGGGS

SEQ ID NO: 26 - protein, 30 aa, Artificial Sequence
  source: /note="Description of Artificial Sequence: Synthetic polypeptide"
  MISC_FEATURE (1)..(30): /note="This sequence may encompass 1-6 "Gly Gly Gly Gly Ser" repeating units"
GGGGSGGGGSGGGGSGGGGSGGGGSGGGGS

SEQ ID NO: 27 - protein, 20 aa, Artificial Sequence
  source: /note="Description of Artificial Sequence: Synthetic peptide"
GGGGSGGGGSGGGGSGGGGS

SEQ ID NO: 28 - protein, 15 aa, Artificial Sequence
  source: /note="Description of Artificial Sequence: Synthetic peptide"
GGGGSGGGGSGGGGS

SEQ ID NO: 29 - protein, 4 aa, Artificial Sequence
  source: /note="Description of Artificial Sequence: Synthetic peptide"
GGGS

SEQ ID NO: 30 - DNA, 5000 bp, Artificial Sequence
  source: /note="Description of Artificial Sequence: Synthetic polynucleotide"
  misc_feature (1)..(5000): /note="This sequence may encompass 50-5000 nucleotides"
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 31 - DNA, 100 bp, Artificial Sequence
  source: /note="Description of Artificial Sequence: Synthetic polynucleotide"
tttttttttttttttttttttttttttttttttttttttttttttttttttttttttttttttttttttttttttttttttttttttttttttttttttt

SEQ ID NO: 32 - DNA, 5000 bp, Artificial Sequence
  source: /note="Description of Artificial Sequence: Synthetic polynucleotide"
  misc_feature (1)..(5000): /note="This sequence may encompass 50-5000 nucleotides"
tttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttt

SEQ ID NO: 33 - DNA, 5000 bp, Artificial Sequence; identical to SEQ ID NO: 30
  source: /note="Description of Artificial Sequence: Synthetic polynucleotide"
  misc_feature (1)..(5000): /note="This sequence may encompass 100-5000 nucleotides"

SEQ ID NO: 34 - DNA, 400 bp, Artificial Sequence
  source: /note="Description of Artificial Sequence: Synthetic polynucleotide"
  misc_feature (1)..(400): /note="This sequence may encompass 100-400 nucleotides"
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 35 - DNA, 2000 bp, Artificial Sequence
  source: /note="Description of Artificial Sequence: Synthetic polynucleotide"
  misc_feature (1)..(2000): /note="This sequence may encompass 50-2000 nucleotides"
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 36 - protein, 41 aa, Artificial Sequence
  source: /note="Description of Artificial Sequence: Synthetic polypeptide"
RSKRSRLLHSDYMNMTPRRPGPTRKHYQPYAPPRDFAAYRS

SEQ ID NO: 37 - DNA, 123 bp, Artificial Sequence; identical to SEQ ID NO: 19
  source: /note="Description of Artificial Sequence: Synthetic polynucleotide"

SEQ ID NO: 38 - protein, 35 aa, Artificial Sequence
  source: /note="Description of Artificial Sequence: Synthetic polypeptide"
TKKKYSSSVHDPNGEYMFMRAVNTAKKSRLTDVTL

SEQ ID NO: 39 - DNA, 105 bp, Artificial Sequence
  source: /note="Description of Artificial Sequence: Synthetic polynucleotide"
acaaaaaagaagtattcatccagtgtgcacgaccctaacggtgaatacatgttcatgagagcagtgaacacagccaaaaaatccagactcacagatgtgacccta

SEQ ID NO: 40 - protein, 4 aa, Artificial Sequence
  source: /note="Description of Artificial Sequence: Synthetic peptide"
  MISC_FEATURE (1)..(4): /note="See specification as filed for detailed description of substitutions and preferred embodiments"
GGGS

SEQ ID NO: 41 - protein, 40 aa, Artificial Sequence
  source: /note="Description of Artificial Sequence: Synthetic polypeptide"
  MISC_FEATURE (1)..(40): /note="This sequence may encompass 1-10 "Gly Gly Gly Ser" repeating units"
GGGSGGGSGGGSGGGSGGGSGGGSGGGSGGGSGGGSGGGS

SEQ ID NO: 42 - protein, 18 aa, Artificial Sequence
  source: /note="Description of Artificial Sequence: Synthetic peptide"
GSTSGSGKPGSGEGSTKG

SEQ ID NO: 43 - protein, 132 aa, Artificial Sequence
  source: /note="Description of Artificial Sequence: Synthetic polypeptide"
DVPDYASLGGPSSPKKKRKVSRGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLETSY

SEQ ID NO: 44 - protein, 108 aa, Artificial Sequence
  source: /note="Description of Artificial Sequence: Synthetic polypeptide"
VQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLETS

SEQ ID NO: 45 - protein, 93 aa, Artificial Sequence [sequence omitted]

SEQ ID NO: 46 - protein, 95 aa, Artificial Sequence
  source: /note="Description of Artificial Sequence: Synthetic polypeptide"
ILWHEMWHEGLIEASRLYFGERNVKGMFEVLEPLHAMMERGPQTLKETSFNQAYGRDLMEAQEWCRKYMKSGNVKDLTQAWDLYYHVFRRISKTS

SEQ ID NO: 47 - protein, 95 aa, Artificial Sequence
  source: /note="Description of Artificial Sequence: Synthetic polypeptide"
ILWHEMWHEGLLEASRLYFGERNVKGMFEVLEPLHAMMERGPQTLKETSFNQAYGRDLMEAQEWCRKYMKSGNVKDLTQAWDLYYHVFRRISKTS

SEQ ID NO: 48 - protein, 95 aa, Artificial Sequence
  source: /note="Description of Artificial Sequence: Synthetic polypeptide"
ILWHEMWHEGLEEASRLYFGERNVKGMFEVLEPLHAMMERGPQTLKETSFNQAYGRDLMEAQEWCRKYMKSGNVKDLLQAWDLYYHVFRRISKTS

SEQ ID NO: 49 - protein, 95 aa, Artificial Sequence
  source: /note="Description of Artificial Sequence: Synthetic polypeptide"
  MOD_RES (12)..(12): Any amino acid
  MOD_RES (78)..(78): Any amino acid
ILWHEMWHEGLXEASRLYFGERNVKGMFEVLEPLHAMMERGPQTLKETSFNQAYGRDLMEAQEWCRKYMKSGNVKDLXQAWDLYYHVFRRISKTS

SEQ ID NO: 50 - protein, 95 aa, Artificial Sequence
  source: /note="Description of Artificial Sequence: Synthetic polypeptide"
ILWHEMWHEGLIEASRLYFGERNVKGMFEVLEPLHAMMERGPQTLKETSFNQAYGRDLMEAQEWCRKYMKSGNVKDLLQAWDLYYHVFRRISKTS

SEQ ID NO: 51 - protein, 95 aa, Artificial Sequence
  source: /note="Description of Artificial Sequence: Synthetic polypeptide"
ILWHEMWHEGLLEASRLYFGERNVKGMFEVLEPLHAMMERGPQTLKETSFNQAYGRDLMEAQEWCRKYMKSGNVKDLLQAWDLYYHVFRRISKTS

SEQ ID NO: 52 - DNA, 521 bp, Unknown
  source: /note="Description of Unknown: Wild-type PGK promoter"
acccctctctccagccactaagccagttgctccctcggctgacggctgcacgcgaggcctccgaacgtcttacgccttgtggcgcgcccgtccttgtcccgggtgtgatggcggggtgtggggcggagggcgtggcggggaagggccggcgacgagagccgcgcgggacgactcgtcggcgataaccggtgtcgggtagcgccagccgcgcgacggtaacgagggaccgcgacaggcagacgctcccatgatcactctgcacgccgaaggcaaatagtgcaggccgtgcggcgcttggcgttccttggaagggctgaatccccgcctcgtccttcgcagcggccccccgggtgttcccatcgccgcttctaggcccactgcgacgcttgcctgcacttcttacacgctctgggtcccagccgcggcgacgcaaagggccttggtgcgggtctcgtcggcgcagggacgcgtttgggtcccgacggaaccttttccgcgttggggttggggcaccataagct

SEQ ID NO: 53 - DNA, 118 bp, Artificial Sequence
  source: /note="Description of Artificial Sequence: Synthetic polynucleotide"
acccctctctccagccactaagccagttgctccctcggctgacggctgcacgcgaggcctccgaacgtcttacgccttgtggcgcgcccgtccttgtcccgggtgtgatggcggggtg

SEQ ID NO: 54 - DNA, 221 bp, Artificial Sequence
  source: /note="Description of Artificial Sequence: Synthetic polynucleotide"
acccctctctccagccactaagccagttgctccctcggctgacggctgcacgcgaggcctccgaacgtcttacgccttgtggcgcgcccgtccttgtcccgggtgtgatggcggggtgtggggcggagggcgtggcggggaagggccggcgacgagagccgcgcgggacgactcgtcggcgataaccggtgtcgggtagcgccagccgcgcgacggtaacg

SEQ ID NO: 55 - DNA, 324 bp, Artificial Sequence
  source: /note="Description of Artificial Sequence: Synthetic polynucleotide"
acccctctctccagccactaagccagttgctccctcggctgacggctgcacgcgaggcctccgaacgtcttacgccttgtggcgcgcccgtccttgtcccgggtgtgatggcggggtgtggggcggagggcgtggcggggaagggccggcgacgagagccgcgcgggacgactcgtcggcgataaccggtgtcgggtagcgccagccgcgcgacggtaacgagggaccgcgacaggcagacgctcccatgatcactctgcacgccgaaggcaaatagtgcaggccgtgcggcgcttggcgttccttggaagggctgaatccccg

SEQ ID NO: 56 - DNA, 422 bp, Artificial Sequence
  source: /note="Description of Artificial Sequence: Synthetic polynucleotide"
acccctctctccagccactaagccagttgctccctcggctgacggctgcacgcgaggcctccgaacgtcttacgccttgtggcgcgcccgtccttgtcccgggtgtgatggcggggtgtggggcggagggcgtggcggggaagggccggcgacgagagccgcgcgggacgactcgtcggcgataaccggtgtcgggtagcgccagccgcgcgacggtaacgagggaccgcgacaggcagacgctcccatgatcactctgcacgccgaaggcaaatagtgcaggccgtgcggcgcttggcgttccttggaagggctgaatccccgcctcgtccttcgcagcggccccccgggtgttcccatcgccgcttctaggcccactgcgacgcttgcctgcacttcttacacgctctgggtcccagccg

SEQ ID NO: 57 - protein, 21 aa, Artificial Sequence
  source: /note="Description of Artificial Sequence: Synthetic peptide"
  VARIANT (1)..(3): /replace=" "
  MISC_FEATURE (1)..(21): /note="Variant residues given in the sequence have no preference with respect to those in the annotations for variant positions"
GSGEGRGSLLTCGDVEENPGP

SEQ ID NO: 58 - protein, 22 aa, Artificial Sequence
  source: /note="Description of Artificial Sequence: Synthetic peptide"
  VARIANT (1)..(3): /replace=" "
  MISC_FEATURE (1)..(22): /note="Variant residues given in the sequence have no preference with respect to those in the annotations for variant positions"
GSGATNFSLLKQAGDVEENPGP

SEQ ID NO: 59 - protein, 23 aa, Artificial Sequence
  source: /note="Description of Artificial Sequence: Synthetic peptide"
  VARIANT (1)..(3): /replace=" "
  MISC_FEATURE (1)..(23): /note="Variant residues given in the sequence have no preference with respect to those in the annotations for variant positions"
GSGQCTNYALLKLAGDVESNPGP

SEQ ID NO: 60 - protein, 25 aa, Artificial Sequence
  source: /note="Description of Artificial Sequence: Synthetic peptide"
  VARIANT (1)..(3): /replace=" "
  MISC_FEATURE (1)..(25): /note="Variant residues given in the sequence have no preference with respect to those in the annotations for variant positions"
GSGVKQTLNFDLLKLAGDVESNPGP

SEQ ID NO: 61 - protein, 1132 aa, Homo sapiens [sequence omitted]

SEQ ID NO: 62 - DNA, 4027 bp, Homo sapiens
caggcagcgtggtcctgctgcgcacgtgggaagccctggccccggccacccccgcgatgccgcgcgctccccgctgccgagccgtgcgctccctgctgcgcagccactaccgcgaggtgctgccgctggccacgttcgtgcggcgcctggggccccagggctggcggctggtgcagcgcggggacccggcggctttccgcgcgctggtggcccagtgcctggtgtgcgtgccctgggacgcacggccgccccccgccgccccctccttccgccaggtgtcctgcctgaaggagctggtggcccgagtgctgcagaggctgtgcgagcgcggcgcgaagaacgtgctggccttcggcttcgcgctgctggacggggcccgcgggggcccccccgaggccttcaccaccagcgtgcgcagctacctgcccaacacggtgaccgacgcactgcgggggagcggggcgtgggggctgctgttgcgccgcgtgggcgacgacgtgctggttcacctgctggcacgctgcgcgctctttgtgctggtggctcccagctgcgcctaccaggtgtgcgggccgccgctgtaccagctcggcgctgccactcaggcccggcccccgccacacgctagtggaccccgaaggcgtctgggatgcgaacgggcctggaaccatagcgtcagggaggccggggtccccctgggcctgccagccccgggtgcgaggaggcgcgggggcagtgccagccgaagtctgccgttgcccaagaggcccaggcgtggcgctgcccctgagccggagcggacgcccgttgggcaggggtcctgggcccacccgggcaggacgcgtggaccgagtgaccgtggtttctgtgtggtgtcacctgccagacccgccgaagaagccacctctttggagggtgcgctctctggcacgcgccactcccacccatccgtgggccgccagcaccacgcgggccccccatccacatcgcggccaccacgtccctgggacacgccttgtcccccggtgtacgccgagaccaagcacttcctctactcctcaggcgacaaggagcagctgcggccctccttcctactcagctctctgaggcccagcctgactggcgctcggaggctcgtggagaccatctttctgggttccaggccctggatgccagggactccccgcaggttgccccgcctgccccagcgctactggcaaatgcggcccctgtttctggagctgcttgggaaccacgcgcagtgcccctacggggtgctcctcaagacgcactgcccgctgcgagctgcggtcaccccagcagccggtgtctgtgcccgggagaagccccagggctctgtggcggcccccgaggaggaggacacagacccccgtcgcctggtgcagctgctccgccagcacagcagcccctggcaggtgtacggcttcgtgcgggcctgcctgcgccggctggtgcccccaggcctctggggctccaggcacaacgaacgccgcttcctcaggaacaccaagaagttcatctccctggggaagcatgccaagctctcgctgcaggagctgacgtggaagatgagcgtgcggggctgcgcttggctgcgcaggagcccaggggttggctgtgttccggccgcagagcaccgtctgcgtgaggagatcctggccaagttcctgcactggctgatgagtgtgtacgtcgtcgagctgctcaggtctttcttttatgtcacggagaccacgtttcaaaagaacaggctctttttctaccggaagagtgtctggagcaagttgcaaagcattggaatcagacagcacttgaagagggtgcagctgcgggagctgtcggaagcagaggtcaggcagcatcgggaagccaggcccgccctgctgacgtccagactccgcttcatccccaagcctgacgggctgcggccgattgtgaacatggactacgtcgtgggagccagaacgttccgcagagaaaagagggccgagcgtctcacctcgagggtgaaggcactgttcagcgtgctcaactacgagcgggcgcggcgccccggcctcctgggcgcctctgtgctgggcctggacgatatccacagggcctggcgcaccttcgtgctgcgtgtgcgggcccaggacccgccgcctgagctgtactttgtcaaggtggatgtgacgggcgcgtacgacaccatcccccaggacaggctcacggaggtcatcgccagcatcatcaaaccccagaacacgtactgcgtgcgtcggtatgccgtggtccagaaggccgcccatgggcacgtccgcaaggccttcaagagccacgtctctaccttgacagacctccagccgtacatgcgacagttcgtggctcacctgcaggagaccagcccgctgagggatgccgtcgtcatcgagcagagctcctccctgaatgaggccagcagtggcctcttcgacgtcttcctacgcttcatgtgccaccacgccgtgcgcatcaggggcaagtcctacgtccagtgccaggggatcccgcagggctccatcctctccacgctgctctgcagcctgtgctacggcgacatggagaacaagctgtttgcggggattcggcgggacgggctgctcctgcgtttggtggatgatttcttgttggtgacacctcacctcacccacgcgaaaaccttcctcaggaccctggtccgaggtgtccctgagtatggctgcgtggtgaacttgcggaagacagtggtgaacttccctgtagaagacgaggccctgggtggcacggcttttgttcagatgccggcccacggcctattcccctggtgcggcctgctgctggatacccggaccctggaggtgcagagcgactactccagctatgcccggacctccatcagagccagtctcaccttcaaccgcggcttcaaggctgggaggaacatgcgtcgcaaactctttggggtcttgcggctgaagtgtcacagcctgtttctggatttgcaggtgaacagcctccagacggtgtgcaccaacatctacaagatcctcctgctgcaggcgtacaggtttcacgcatgtgtgctgcagctcccatttcatcagcaagtttggaagaaccccacatttttcctgcgcgtcatctctgacacggcctccctctgctactccatcctgaaagccaagaacgcagggatgtcgctgggggccaagggcgccgccggccctctgccctccgaggccgtgcagtggctgtgccaccaagcattcctgctcaagctgactcgacaccgtgtcacctacgtgccactcctggggtcactcaggacagcccagacgcagctgagtcggaagctcccggggacgacgctgactgccctggaggccgcagccaacccggcactgccctcagacttcaagaccatcctggactgatggccacccgcccacagccaggccgagagcagacaccagcagccctgtcacgccgggctctacgtcccagggagggaggggcggcccacacccaggcccgcaccgctgggagtctgaggcctgagtgagtgtttggccgaggcctgcatgtccggctgaaggctgagtgtccggctgaggcctgagcgagtgtccagccaagggctgagtgtccagcacacctgccgtcttcacttccccacaggctggcgctcggctccaccccagggccagcttttcctcaccaggagcccggcttccactccccacataggaatagtccatccccagattcgccattgttcacccctcgccctgccctcctttgccttccacccccaccatccaggtggagaccctgagaaggaccctgggagctctgggaatttggagtgaccaaaggtgtgccctgtacacaggcgaggaccctgcacctggatgggggtccctgtgggtcaaattggggggaggtgctgtgggagtaaaatactgaatatatgagtttttcagttttgaaaaaaaaaaaaaaaaaa

SEQ ID NO: 63 - protein, 30 aa, Artificial Sequence; identical to SEQ ID NO: 26
  source: /note="Description of Artificial Sequence: Synthetic polypeptide"
  MISC_FEATURE (1)..(30): /note="This sequence may encompass 1-6 "Gly Gly Gly Gly Ser" repeating units"

SEQ ID NO: 64 - protein, 4 aa, Artificial Sequence
  source: /note="Description of Artificial Sequence: Synthetic peptide"
RGDS

SEQ ID NO: 65 - DNA, 19 bp, Mus musculus
ggaggtccctcaccttcta

SEQ ID NO: 66 - DNA, 19 bp, Mus musculus
cggaggatcttatgctgaa

SEQ ID NO: 67 - DNA, 19 bp, Mus musculus
cccgcttccagatcataca

SEQ ID NO: 68 - DNA, 19 bp, Mus musculus
ggagacctcaacaagatat

SEQ ID NO: 69 - DNA, 19 bp, Mus musculus
aaggcatggtcattggtat

SEQ ID NO: 70 - DNA, 19 bp, Mus musculus
gcatggtcattggtatcat

SEQ ID NO: 71 - DNA, 19 bp, Mus musculus
ggtcattggtatcatgagt

SEQ ID NO: 72 - DNA, 19 bp, Mus musculus
cctagtgggtatccctgta

SEQ ID NO: 73 - DNA, 19 bp, Mus musculus
gaggatggacattgttctt

SEQ ID NO: 74 - DNA, 19 bp, Mus musculus
gcatgcaggctacagttca

SEQ ID NO: 75 - DNA, 19 bp, Mus musculus
ccagcacatgcactgttga

SEQ ID NO: 76 - DNA, 19 bp, Mus musculus
cacatgcactgttgagtga

SEQ ID NO: 77 - DNA, 21 bp, Mus musculus
ctggaggtccctcaccttcta

SEQ ID NO: 78 - DNA, 21 bp, Mus musculus
gtcggaggatcttatgctgaa

SEQ ID NO: 79 - DNA, 21 bp, Mus musculus
tgcccgcttccagatcataca

SEQ ID NO: 80 - DNA, 21 bp, Mus musculus
ctggagacctcaacaagatat

SEQ ID NO: 81 - DNA, 21 bp, Mus musculus
tcaaggcatggtcattggtat

SEQ ID NO: 82 - DNA, 21 bp, Mus musculus
aggcatggtcattggtatcat

SEQ ID NO: 83 - DNA, 21 bp, Mus musculus
atggtcattggtatcatgagt

SEQ ID NO: 84 - DNA, 21 bp, Mus musculus
gccctagtgggtatccctgta

SEQ ID NO: 85 - DNA, 21 bp, Mus musculus
atgaggatggacattgttctt

SEQ ID NO: 86 - DNA, 21 bp, Mus musculus
gagcatgcaggctacagttca

SEQ ID NO: 87 - DNA, 21 bp, Mus musculus
ttccagcacatgcactgttga

SEQ ID NO: 88 - DNA, 21 bp, Mus musculus
agcacatgcactgttgagtga

SEQ ID NO: 89 - DNA, 21 bp, Mus musculus
tagaaggtgagggacctccag

SEQ ID NO: 90 - DNA, 21 bp, Mus musculus
ttcagcataagatcctccgac

SEQ ID NO: 91 - DNA, 21 bp, Mus musculus
tgtatgatctggaagcgggca

SEQ ID NO: 92 - DNA, 21 bp, Mus musculus
atatcttgttgaggtctccag

SEQ ID NO: 93 - DNA, 21 bp, Mus musculus
ataccaatgaccatgccttga

SEQ ID NO: 94 - DNA, 21 bp, Mus musculus
atgataccaatgaccatgcct

SEQ ID NO: 95 - DNA, 21 bp, Mus musculus
atggtcattggtatcatgagt

SEQ ID NO: 96 - DNA, 21 bp, Mus musculus
gccctagtgggtatccctgta

SEQ ID NO: 97 - DNA, 21 bp, Mus musculus
atgaggatggacattgttctt

SEQ ID NO: 98 - DNA, 21 bp, Mus musculus
gagcatgcaggctacagttca

SEQ ID NO: 99 - DNA, 21 bp, Mus musculus
ttccagcacatgcactgttga

SEQ ID NO: 100 - DNA, 21 bp, Mus musculus
agcacatgcactgttgagtga

SEQ ID NO: 101 - DNA, 19 bp, Mus musculus
tagaaggtgagggacctcc

SEQ ID NO: 102 - DNA, 19 bp, Mus musculus
ttcagcataagatcctccg

SEQ ID NO: 103 - DNA, 19 bp, Mus musculus
tgtatgatctggaagcggg

SEQ ID NO: 104 - DNA, 19 bp, Mus musculus
atatcttgttgaggtctcc

SEQ ID NO: 105 - DNA, 19 bp, Mus musculus
ataccaatgaccatgcctt

SEQ ID NO: 106 - DNA, 19 bp, Mus musculus
atgataccaatgaccatgc

SEQ ID NO: 107 - DNA, 19 bp, Mus musculus
atggtcattggtatcatga

SEQ ID NO: 108 - DNA, 19 bp, Mus musculus
gccctagtgggtatccctg

SEQ ID NO: 109 - DNA, 19 bp, Mus musculus
atgaggatggacattgttc

SEQ ID NO: 110 - DNA, 19 bp, Mus musculus
gagcatgcaggctacagtt

SEQ ID NO: 111 - DNA, 19 bp, Mus musculus
ttccagcacatgcactgtt

SEQ ID NO: 112 - DNA, 19 bp, Mus musculus
agcacatgcactgttgagt

SEQ ID NO: 113 - DNA, 19 bp, Homo sapiens
ggccaggatggttcttaga

SEQ ID NO: 114 - DNA, 19 bp, Homo sapiens
gcttcgtgctaaactggta

SEQ ID NO: 115 - DNA, 19 bp, Homo sapiens
gggcgtgacttccacatga

SEQ ID NO: 116 - DNA, 19 bp, Homo sapiens
caggcctagagaagtttca

SEQ ID NO: 117 - DNA, 19 bp, Homo sapiens
cttggaacccattcctgaa

SEQ ID NO: 118 - DNA, 19 bp, Homo sapiens
ggaacccattcctgaaatt

SEQ ID NO: 119 - DNA, 19 bp, Homo sapiens
gaacccattcctgaaatta

SEQ ID NO: 120 - DNA, 19 bp, Homo sapiens
aacccattcctgaaattat

SEQ ID NO: 121 - DNA, 19 bp, Homo sapiens
acccattcctgaaattatt

SEQ ID NO: 122 - DNA, 19 bp, Homo sapiens
cccattcctgaaattattt

SEQ ID NO: 123 - DNA, 19 bp, Homo sapiens
ctgtggttctattatatta

SEQ ID NO: 124 - DNA, 19 bp, Homo sapiens
aaatatgagagcatgctaa

SEQ ID NO: 125 - DNA, 19 bp, Homo sapiens
tctaagaaccatcctggcc

SEQ ID NO: 126 - DNA, 19 bp, Homo sapiens
taccagtttagcacgaagc

SEQ ID NO: 127 - DNA, 19 bp, Homo sapiens
tcatgtggaagtcacgccc

SEQ ID NO: 128 - DNA, 19 bp, Homo sapiens
tgaaacttctctaggcctg

SEQ ID NO: 129 - DNA, 19 bp, Homo sapiens
ttcaggaatgggttccaag

SEQ ID NO: 130 - DNA, 19 bp, Homo sapiens
aatttcaggaatgggttcc

SEQ ID NO: 131 - DNA, 19 bp, Homo sapiens
taatttcaggaatgggttc

SEQ ID NO: 132 - DNA, 19 bp, Homo sapiens
ataatttcaggaatgggtt

SEQ ID NO: 133 - DNA, 19 bp, Homo sapiens
aataatttcaggaatgggt

SEQ ID NO: 134 - DNA, 19 bp, Homo sapiens
aaataatttcaggaatggg

SEQ ID NO: 135 - DNA, 19 bp, Homo sapiens
taatataatagaaccacag

SEQ ID NO: 136 - DNA, 19 bp, Homo sapiens
ttagcatgctctcatattt

SEQ ID NO: 137 - DNA, 21 bp, Homo sapiens
gcggccaggatggttcttaga

SEQ ID NO: 138 - DNA, 21 bp, Homo sapiens
gagcttcgtgctaaactggta

SEQ ID NO: 139 - DNA, 21 bp, Homo sapiens
acgggcgtgacttccacatga

SEQ ID NO: 140 - DNA, 21 bp, Homo sapiens
tgcaggcctagagaagtttca

SEQ ID NO: 141 - DNA, 21 bp, Homo sapiens
tccttggaacccattcctgaa

SEQ ID NO: 142 - DNA, 21 bp, Homo sapiens
ttggaacccattcctgaaatt

SEQ ID NO: 143 - DNA, 21 bp, Homo sapiens
tggaacccattcctgaaatta

SEQ ID NO: 144 - DNA, 21 bp, Homo sapiens
ggaacccattcctgaaattat

SEQ ID NO: 145 - DNA, 21 bp, Homo sapiens
gaacccattcctgaaattatt

SEQ ID NO: 146 - DNA, 21 bp, Homo sapiens
aacccattcctgaaattattt

SEQ ID NO: 147 - DNA, 21 bp, Homo sapiens
ccctgtggttctattatatta

SEQ ID NO: 148 - DNA, 21 bp, Homo sapiens
ttaaatatgagagcatgctaa

SEQ ID NO: 149 - DNA, 21 bp, Homo sapiens
tctaagaaccatcctggccgc

SEQ ID NO: 150 - DNA, 21 bp, Homo sapiens
taccagtttagcacgaagctc

SEQ ID NO: 151 - DNA, 21 bp, Homo sapiens
tcatgtggaagtcacgcccgt

SEQ ID NO: 152 - DNA, 21 bp, Homo sapiens
tgaaacttctctaggcctgca

SEQ ID NO: 153 - DNA, 21 bp, Homo sapiens
ttcaggaatgggttccaagga

SEQ ID NO: 154 - DNA, 21 bp, Homo sapiens
aatttcaggaatgggttccaa

SEQ ID NO: 155 - DNA, 21 bp, Homo sapiens
taatttcaggaatgggttcca

SEQ ID NO: 156 - DNA, 21 bp, Homo sapiens
ataatttcaggaatgggttcc

SEQ ID NO: 157 - DNA, 21 bp, Homo sapiens
aataatttcaggaatgggttc

SEQ ID NO: 158 - DNA, 21 bp, Homo sapiens
aaataatttcaggaatgggtt

SEQ ID NO: 159 - DNA, 21 bp, Homo sapiens
taatataatagaaccacaggg

SEQ ID NO: 160 - DNA, 21 bp, Homo sapiens
ttagcatgctctcatatttaa

SEQ ID NO: 161 - protein, 242 aa, Artificial Sequence
  source: /note="Description of Artificial Sequence: Synthetic polypeptide"
EIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSS

SEQ ID NO: 162 - protein, 242 aa, Artificial Sequence
  source: /note="Description of Artificial Sequence: Synthetic polypeptide"
EIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSS

SEQ ID NO: 163 - protein, 242 aa, Artificial Sequence
  source: /note="Description of Artificial Sequence: Synthetic polypeptide"
QVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIK

SEQ ID NO: 164 - protein, 242 aa, Artificial Sequence
  source: /note="Description of Artificial Sequence: Synthetic polypeptide"
QVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIK

SEQ ID NO: 165 - protein, 247 aa, Artificial Sequence
  source: /note="Description of Artificial Sequence: Synthetic polypeptide"
EIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSGGGGSQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSS

SEQ ID NO: 166 - protein, 247 aa, Artificial Sequence
  source: /note="Description of Artificial Sequence: Synthetic polypeptide"
EIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSS

SEQ ID NO: 167 - protein, 247 aa, Artificial Sequence
  source: /note="Description of Artificial Sequence: Synthetic polypeptide"
QVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIK

SEQ ID NO: 168 - protein, 247 aa, Artificial Sequence
  source: /note="Description of Artificial Sequence: Synthetic polypeptide"
QVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIK

SEQ ID NO: 169 - protein, 247 aa, Artificial Sequence
  source: /note="Description of Artificial Sequence: Synthetic polypeptide"
EIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSGGGGSQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSS

SEQ ID NO: 170 - protein, 247 aa, Artificial Sequence
  source: /note="Description of Artificial Sequence: Synthetic polypeptide"
QVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIK

SEQ ID NO: 171 - protein, 242 aa, Artificial Sequence
  source: /note="Description of Artificial Sequence: Synthetic polypeptide"
EIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSS

SEQ ID NO: 172 - protein, 242 aa, Artificial Sequence
  source: /note="Description of Artificial Sequence: Synthetic polypeptide"
QVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIK

SEQ ID NO: 173 - protein, 242 aa, Artificial Sequence
  source: /note="Description of Artificial Sequence: Synthetic polypeptide"
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSS

SEQ ID NO: 174 - protein, 244 aa, Artificial Sequence
  source: /note="Description of Artificial Sequence: Synthetic polypeptide"
DIVLTQSPASLAVSLGQRATISCRASESVDNYGNTFMHWYQQKPGQPPKLLIYRASNLESGIPARFSGSGSRTDFTLTINPVEADDVATYYCQQSNEDPPTFGAGTKLELKGGGGSGGGGSSGGGSQIQLVQSGPELKKPGETVKISCKASGYIFTNYGMNWVKQAPGKSFKWMGWINTYTGESTYSADFKGRFAFSLETSASTAYLHINDLKNEDTATYFCARSGGYDPMDYWGQGTSVTVSS

SEQ ID NO: 175 - protein, 237 aa, Artificial Sequence
  source: /note="Description of Artificial Sequence: Synthetic polypeptide"
DVQITQSPSYLAASPGETITINCRASKSISKDLAWYQEKPGKTNKLLIYSGSTLQSGIPSRFSGSGSGTDFTLTISSLEPEDFAMYYCQQHNKYPYTFGGGTKLEIKGGGGSGGGGSSGGGSQVQLQQPGAELVRPGASVKLSCKASGYTFTSYWMNWVKQRPDQGLEWIGRIDPYDSETHYNQKFKDKAILTVDKSSSTAYMQLSSLTSEDSAVYYCARGNWDDYWGQGTTLTVSS

SEQ ID NO: 176 - protein, 249 aa, Artificial Sequence
  source: /note="Description of Artificial Sequence: Synthetic polypeptide"
DIVLTQSPDSLAVSLGERATINCRASESVDNYGNTFMHWYQQKPGQPPKLLIYRASNLESGVPDRFSGSGSRTDFTLTISSLQAEDVAVYYCQQSNEDPPTFGQGTKLEIKGGGGSGGGGSGGGGSGGGGSQIQLVQSGSELKKPGASVKVSCKASGYIFTNYGMNWVRQAPGQGLEWMGWINTYTGESTYSADFKGRFVFSLDTSVSTAYLQINALKAEDTAVYYCARSGGYDPMDYWGQGTTVTVSS

SEQ ID NO: 177 - protein, 249 aa, Artificial Sequence
  source: /note="Description of Artificial Sequence: Synthetic polypeptide"
DIVLTQSPDSLAVSLGERATINCRASESVDNYGNTFMHWYQQKPGQPPKLLIYRASNLESGVPDRFSGSGSRTDFTLTISSLQAEDVAVYYCQQSNEDPPTFGQGTKLEIKGGGGSGGGGSGGGGSGGGGSQIQLVQSGAEVKKPGASVKVSCKASGYIFTNYGMNWVRQAPGQRLEWMGWINTYTGESTYSADFKGRVTITLDTSASTAYMELSSLRSEDTAVYYCARSGGYDPMDYWGQGTTVTVSS

SEQ ID NO: 178 - protein, 249 aa, Artificial Sequence
  source: /note="Description of Artificial Sequence: Synthetic polypeptide"
EIVLTQSPATLSLSPGERATLSCRASESVDNYGNTFMHWYQQKPGQAPRLLIYRASNLESGIPARFSGSGSRTDFTLTISSLEPEDVAVYYCQQSNEDPPTFGQGTKLEIKGGGGSGGGGSGGGGSGGGGSQIQLVQSGSELKKPGASVKVSCKASGYIFTNYGMNWVRQAPGQGLEWMGWINTYTGESTYSADFKGRFVFSLDTSVSTAYLQINALKAEDTAVYYCARSGGYDPMDYWGQGTTVTVSS

SEQ ID NO: 179 - protein, 249 aa, Artificial Sequence
  source: /note="Description of Artificial Sequence: Synthetic polypeptide"
EIVLTQSPATLSLSPGERATLSCRASESVDNYGNTFMHWYQQKPGQAPRLLIYRASNLESGIPARFSGSGSRTDFTLTISSLEPEDVAVYYCQQSNEDPPTFGQGTKLEIKGGGGSGGGGSGGGGSGGGGSQIQLVQSGAEVKKPGASVKVSCKASGYIFTNYGMNWVRQAPGQRLEWMGWINTYTGESTYSADFKGRVTITLDTSASTAYMELSSLRSEDTAVYYCARSGGYDPMDYWGQGTTVTVSS

SEQ ID NO: 180 - protein, 249 aa, Artificial Sequence
  source: /note="Description of Artificial Sequence: Synthetic polypeptide"
QIQLVQSGSELKKPGASVKVSCKASGYIFTNYGMNWVRQAPGQGLEWMGWINTYTGESTYSADFKGRFVFSLDTSVSTAYLQINALKAEDTAVYYCARSGGYDPMDYWGQGTTVTVSSGGGGSGGGGSGGGGSGGGGSDIVLTQSPDSLAVSLGERATINCRASESVDNYGNTFMHWYQQKPGQPPKLLIYRASNLESGVPDRFSGSGSRTDFTLTISSLQAEDVAVYYCQQSNEDPPTFGQGTKLEIK

SEQ ID NO: 181 - protein, 249 aa, Artificial Sequence
  source: /note="Description of Artificial Sequence: Synthetic polypeptide"
QIQLVQSGSELKKPGASVKVSCKASGYIFTNYGMNWVRQAPGQGLEWMGWINTYTGESTYSADFKGRFVFSLDTSVSTAYLQINALKAEDTAVYYCARSGGYDPMDYWGQGTTVTVSSGGGGSGGGGSGGGGSGGGGSEIVLTQSPATLSLSPGERATLSCRASESVDNYGNTFMHWYQQKPGQAPRLLIYRASNLESGIPARFSGSGSRTDFTLTISSLEPEDVAVYYCQQSNEDPPTFGQGTKLEIK

SEQ ID NO: 182 - protein, 249 aa, Artificial Sequence
  source: /note="Description of Artificial Sequence: Synthetic polypeptide"
QIQLVQSGAEVKKPGASVKVSCKASGYIFTNYGMNWVRQAPGQRLEWMGWINTYTGESTYSADFKGRVTITLDTSASTAYMELSSLRSEDTAVYYCARSGGYDPMDYWGQGTTVTVSSGGGGSGGGGSGGGGSGGGGSDIVLTQSPDSLAVSLGERATINCRASESVDNYGNTFMHWYQQKPGQPPKLLIYRASNLESGVPDRFSGSGSRTDFTLTISSLQAEDVAVYYCQQSNEDPPTFGQGTKLEIK

SEQ ID NO: 183 - protein, 249 aa, Artificial Sequence
  source: /note="Description of Artificial Sequence: Synthetic polypeptide"
QIQLVQSGAEVKKPGASVKVSCKASGYIFTNYGMNWVRQAPGQRLEWMGWINTYTGESTYSADFKGRVTITLDTSASTAYMELSSLRSEDTAVYYCARSGGYDPMDYWGQGTTVTVSSGGGGSGGGGSGGGGSGGGGSEIVLTQSPATLSLSPGERATLSCRASESVDNYGNTFMHWYQQKPGQAPRLLIYRASNLESGIPARFSGSGSRTDFTLTISSLEPEDVAVYYCQQSNEDPPTFGQGTKLEIK

SEQ ID NO: 184 - protein, 264 aa, Artificial Sequence
  source: /note="Description of Artificial Sequence: Synthetic polypeptide"
MALPVTALLLPLALLLHAARPQVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARDMNILATVPFDIWGQGTMVTVSSGGGGSGGGGSGGGGSDIQMTQSPSSLSASVGDRVTITCRASQSISTYLNWYQQKPGKAPNLLIYAAFSLQSGVPSRFSGSGSGTDFTLTINSLQPEDFATYYCQQGDSVPLTFGGGTKLEIK

SEQ ID NO: 185 - protein, 264 aa, Artificial Sequence
  source: /note="Description of Artificial Sequence: Synthetic polypeptide"
MALPVTALLLPLALLLHAARPQVQLVQSGAEVKKPGASVKVSCKASGYTFTGYYMHWVRQAPGQGLEWMGWINPNSGGTNYAQKFQGRVTLTRDTSISTVYMELSRLRSDDTAVYYCARDMNILATVPFDIWGQGTMVTVSSGGGGSGGGGSGGGGSDIQMTQSPSSLSASVGDRVTITCRASQSISSYLNWYQQKPGKAPKLLIYAASSLQSGVPSRFSGSGSGTDFTLTVNSLQPEDFATYYCQQGDSVPLTFGGGTRLEIK

SEQ ID NO: 186 - protein, 264 aa, Artificial Sequence
  source: /note="Description of Artificial Sequence: Synthetic polypeptide"
MALPVTALLLPLALLLHAARPQVQLVQSGAEVKKPGASVKVSCKASGYIFTGYYIHWVRQAPGQGLEWMGWINPNSGGTNYAQKFQGRVTMTRDTSISTAYMELSGLRSDDPAVYYCARDMNILATVPFDIWGQGTLVTVSSGGGGSGGGGSGGGGSDIQLTQSPSSLSASVGDRVTITCRASQSISSYLNWYQQKPGKAPKLLIYAASSLQSGVPSRFSGSGSGTDFTLTVNSLQPEDFATYYCQQGDSVPLTFGGGTKVEIK

SEQ ID NO: 187 - protein, 266 aa, Artificial Sequence
  source: /note="Description of Artificial Sequence: Synthetic polypeptide"
MALPVTALLLPLALLLHAARPQVQLQQSGAEVKKSGASVKVSCKASGYTFTDYYMHWLRQAPGQGLEWMGWINPNSGDTNYAQKFQGRVTLTRDTSISTVYMELSRLRSDDTAVYYCARDMNILATVPFDIWGQGTMVTVSSASGGGGSGGRASGGGGSDIQMTQSPSSLSASVGDRVTITCRASQSISSYLNWYQQKPGKAPKLLIYAASSLQSGVPSRFSGSGSGTDFTLTISSLQPEDFATYYCQQGDSVPLTFGGGTKVEIK

SEQ ID NO: 188 - protein, 263 aa, Artificial Sequence
  source: /note="Description of Artificial Sequence: Synthetic polypeptide"
MALPVTALLLPLALLLHAARPQVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSSGGGGSGGGGSGGGGSGGGGSDVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIK

SEQ ID NO: 189 - protein, 263 aa, Artificial Sequence
  source: /note="Description of Artificial Sequence: Synthetic polypeptide"
MALPVTALLLPLALLLHAARPQVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSSGGGGSGGGGSGGGGSGGGGSEVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIK

SEQ ID NO: 190 - protein, 263 aa, Artificial Sequence
  source: /note="Description of Artificial Sequence: Synthetic polypeptide"
MALPVTALLLPLALLLHAARPQVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSSGGGGSGGGGSGGGGSGGGGSDVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIK

SEQ ID NO: 191 - protein, 263 aa, Artificial Sequence
  source: /note="Description of Artificial Sequence: Synthetic polypeptide"
MALPVTALLLPLALLLHAARPQVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSSGGGGSGGGGSGGGGSGGGGSDVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIK

SEQ ID NO: 192 - protein, 263 aa, Artificial Sequence
  source: /note="Description of Artificial Sequence: Synthetic polypeptide"
MALPVTALLLPLALLLHAARPDVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIKGGGGSGGGGSGGGGSGGGGSQVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSS

SEQ ID NO: 193 - protein, 263 aa, Artificial Sequence
  source: /note="Description of Artificial Sequence: Synthetic polypeptide"
MALPVTALLLPLALLLHAARPEVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIKGGGGSGGGGSGGGGSGGGGSQVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSS

SEQ ID NO: 194 - protein, 263 aa, Artificial Sequence
  source: /note="Description of Artificial Sequence: Synthetic polypeptide"
MALPVTALLLPLALLLHAARPDVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIKGGGGSGGGGSGGGGSGGGGSQVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSS

SEQ ID NO: 195 - protein, 263 aa, Artificial Sequence
  source: /note="Description of Artificial Sequence: Synthetic polypeptide"
MALPVTALLLPLALLLHAARPDVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIKGGGGSGGGGSGGGGSGGGGSQVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSS

SEQ ID NO: 196 - protein, 263 aa, Artificial Sequence
  source: /note="Description of Artificial Sequence: Synthetic polypeptide"
MALPVTALLLPLALLLHAARPQVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSSGGGGSGGGGSGGGGSGGGGSDVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIK

SEQ ID NO: 197 - protein, 263 aa, Artificial Sequence
  source: /note="Description of Artificial Sequence: Synthetic polypeptide"
MALPVTALLLPLALLLHAARPQVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSSGGGGSGGGGSGGGGSGGGGSEVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIK

SEQ ID NO: 198 - protein, 263 aa, Artificial Sequence
  source: /note="Description of Artificial Sequence: Synthetic polypeptide"
MALPVTALLLPLALLLHAARPQVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSSGGGGSGGGGSGGGGSGGGGSDVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIK

SEQ ID NO: 199 - protein, 263 aa, Artificial Sequence
  source: /note="Description of Artificial Sequence: Synthetic polypeptide"
MALPVTALLLPLALLLHAARPQVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSSGGGGSGGGGSGGGGSGGGGSDVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIK

SEQ ID NO: 200 - protein, 263 aa, Artificial Sequence
  source: /note="Description of Artificial Sequence: Synthetic polypeptide"
MALPVTALLLPLALLLHAARPDVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIKGGGGSGGGGSGGGGSGGGGSQVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSS

SEQ ID NO: 201 - protein, 263 aa, Artificial Sequence
  source: /note="Description of Artificial Sequence: Synthetic polypeptide"
MALPVTALLLPLALLLHAARPEVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIKGGGGSGGGGSGGGGSGGGGSQVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSS

SEQ ID NO: 202 - protein, 263 aa, Artificial Sequence
  source: /note="Description of Artificial Sequence: Synthetic polypeptide"
MALPVTALLLPLALLLHAARPDVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIKGGGGSGGGGSGGGGSGGGGSQVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSS

SEQ ID NO: 203 - protein, 263 aa, Artificial Sequence
  source: /note="Description of Artificial Sequence: Synthetic polypeptide"
MALPVTALLLPLALLLHAARPDVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIKGGGGSGGGGSGGGGSGGGGSQVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSS

SEQ ID NO: 204 - protein, 263 aa, Artificial Sequence
  source: /note="Description of Artificial Sequence: Synthetic polypeptide"
MALPVTALLLPLALLLHAARPEVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSSGGGGSGGGGSGGGGSGGGGSDVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIK

SEQ ID NO: 205 - protein, 263 aa, Artificial Sequence
  source: /note="Description of Artificial Sequence: Synthetic polypeptide"
MALPVTALLLPLALLLHAARPEVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSSGGGGSGGGGSGGGGSGGGGSEVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIK

SEQ ID NO: 206 - protein, 263 aa, Artificial Sequence
  source: /note="Description of Artificial Sequence: Synthetic polypeptide"
MALPVTALLLPLALLLHAARPEVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSSGGGGSGGGGSGGGGSGGGGSDVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIK

SEQ ID NO: 207 - protein, 263 aa, Artificial Sequence
  source: /note="Description of Artificial Sequence: Synthetic polypeptide"
MALPVTALLLPLALLLHAARPEVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSSGGGGSGGGGSGGGGSGGGGSDVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIK

SEQ ID NO: 208 - protein, 263 aa, Artificial Sequence
  source: /note="Description of Artificial Sequence: Synthetic polypeptide"
MALPVTALLLPLALLLHAARPDVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIKGGGGSGGGGSGGGGSGGGGSEVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSS

SEQ ID NO: 209 - protein, 263 aa, Artificial Sequence
  source: /note="Description of Artificial Sequence: Synthetic polypeptide"
MALPVTALLLPLALLLHAARPEVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIKGGGGSGGGGSGGGGSGGGGSEVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSS

SEQ ID NO: 210 - protein, 263 aa, Artificial Sequence
  source: /note="Description of Artificial Sequence: Synthetic polypeptide"
MALPVTALLLPLALLLHAARPDVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIKGGGGSGGGGSGGGGSGGGGSEVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSS

SEQ ID NO: 211 - protein, 263 aa, Artificial Sequence
  source: /note="Description of Artificial Sequence: Synthetic polypeptide"
MALPVTALLLPLALLLHAARPDVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIKGGGGSGGGGSGGGGSGGGGSEVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSS

SEQ ID NO: 212 - protein, 263 aa, Artificial Sequence
  source: /note="Description of Artificial Sequence: Synthetic polypeptide"
MALPVTALLLPLALLLHAARPEVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSSGGGGSGGGGSGGGGSGGGGSDVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIK

SEQ ID NO: 213 - protein, 263 aa, Artificial Sequence
  source: /note="Description of Artificial Sequence: Synthetic polypeptide"
MALPVTALLLPLALLLHAARPEVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSSGGGGSGGGGSGGGGSGGGGSEVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIK

SEQ ID NO: 214 - protein, 263 aa, Artificial Sequence
  source: /note="Description of Artificial Sequence: Synthetic polypeptide"
MALPVTALLLPLALLLHAARPEVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSSGGGGSGGGGSGGGGSGGGGSDVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIK

SEQ ID NO: 215 - protein, 263 aa, Artificial Sequence
  source: /note="Description of Artificial Sequence: Synthetic polypeptide"
MALPVTALLLPLALLLHAARPEVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSSGGGGSGGGGSGGGGSGGGGSDVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIK

SEQ ID NO: 216 - protein, 263 aa, Artificial Sequence
  source: /note="Description of Artificial Sequence: Synthetic polypeptide"
MALPVTALLLPLALLLHAARPDVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIKGGGGSGGGGSGGGGSGGGGSEVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSS

SEQ ID NO: 217 - protein, 263 aa, Artificial Sequence
  source: /note="Description of Artificial Sequence: Synthetic polypeptide"
MALPVTALLLPLALLLHAARPEVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIKGGGGSGGGGSGGGGSGGGGSEVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSS

SEQ ID NO: 218 - protein, 263 aa, Artificial Sequence
  source: /note="Description of Artificial Sequence: Synthetic polypeptide"
MALPVTALLLPLALLLHAARPDVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIKGGGGSGGGGSGGGGSGGGGSEVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSS

SEQ ID NO: 219 - protein, 263 aa, Artificial Sequence
  source: /note="Description of Artificial Sequence: Synthetic polypeptide"
MALPVTALLLPLALLLHAARPDVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIKGGGGSGGGGSGGGGSGGGGSEVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSS

SEQ ID NO: 220 - protein, 246 aa, Artificial Sequence
  source: /note="Description of Artificial Sequence: Synthetic polypeptide"
EIQLVQSGAEVKKPGATVKISCKGSGFNIEDYYIHWVQQAPGKGLEWMGRIDPENDETKYGPIFQGRVTITADTSTNTVYMELSSLRSEDTAVYYCAFRGGVYWGQGTTVTVSSGGGGSGGGGSGGGGSGGGGSDVVMTQSPDSLAVSLGERATINCKSSQSLLDSDGKTYLNWLQQKPGQPPKRLISLVSKLDSGVPDRFSGSGSGTDFTLTISSLQAEDVAVYYCWQGTHFPGTFGGGTKVEIK

SEQ ID NO: 221 - protein, 246 aa, Artificial Sequence
  source: /note="Description of Artificial Sequence: Synthetic polypeptide"
DVVMTQSPDSLAVSLGERATINCKSSQSLLDSDGKTYLNWLQQKPGQPPKRLISLVSKLDSGVPDRFSGSGSGTDFTLTISSLQAEDVAVYYCWQGTHFPGTFGGGTKVEIKGGGGSGGGGSGGGGSGGGGSEIQLVQSGAEVKKPGATVKISCKGSGFNIEDYYIHWVQQAPGKGLEWMGRIDPENDETKYGPIFQGRVTITADTSTNTVYMELSSLRSEDTAVYYCAFRGGVYWGQGTTVTVSS

SEQ ID NO: 222 - protein, 246 aa, Artificial Sequence
  source: /note="Description of Artificial Sequence: Synthetic polypeptide"
EIQLVQSGAEVKKPGESLRISCKGSGFNIEDYYIHWVRQMPGKGLEWMGRIDPENDETKYGPIFQGHVTISADTSINTVYLQWSSLKASDTAMYYCAFRGGVYWGQGTTVTVSSGGGGSGGGGSGGGGSGGGGSDVVMTQSPLSLPVTLGQPASISCKSSQSLLDSDGKTYLNWLQQRPGQSPRRLISLVSKLDSGVPDRFSGSGSGTDFTLKISRVEAEDVGVYYCWQGTHFPGTFGGGTKVEIK

SEQ ID NO: 223 - protein, 246 aa, Artificial Sequence
  source: /note="Description of Artificial Sequence: Synthetic polypeptide"
DVVMTQSPLSLPVTLGQPASISCKSSQSLLDSDGKTYLNWLQQRPGQSPRRLISLVSKLDSGVPDRFSGSGSGTDFTLKISRVEAEDVGVYYCWQGTHFPGTFGGGTKVEIKGGGGSGGGGSGGGGSGGGGSEIQLVQSGAEVKKPGESLRISCKGSGFNIEDYYIHWVRQMPGKGLEWMGRIDPENDETKYGPIFQGHVTISADTSINTVYLQWSSLKASDTAMYYCAFRGGVYWGQGTTVTVSS

SEQ ID NO: 224 - protein, 246 aa, Artificial Sequence
  source: /note="Description of Artificial Sequence: Synthetic polypeptide"
EIQLVQSGAEVKKPGATVKISCKGSGFNIEDYYIHWVQQAPGKGLEWMGRIDPENDETKYGPIFQGRVTITADTSTNTVYMELSSLRSEDTAVYYCAFRGGVYWGQGTTVTVSSGGGGSGGGGSGGGGSGGGGSDVVMTQSPLSLPVTLGQPASISCKSSQSLLDSDGKTYLNWLQQRPGQSPRRLISLVSKLDSGVPDRFSGSGSGTDFTLKISRVEAEDVGVYYCWQGTHFPGTFGGGTKVEIK

SEQ ID NO: 225 - protein, 246 aa, Artificial Sequence
  source: /note="Description of Artificial Sequence: Synthetic polypeptide"
EIQLVQSGAEVKKPGESLRISCKGSGFNIEDYYIHWVRQMPGKGLEWMGRIDPENDETKYGPIFQGHVTISADTSINTVYLQWSSLKASDTAMYYCAFRGGVYWGQGTTVTVSSGGGGSGGGGSGGGGSGGGGSDVVMTQSPDSLAVSLGERATINCKSSQSLLDSDGKTYLNWLQQKPGQPPKRLISLVSKLDSGVPDRFSGSGSGTDFTLTISSLQAEDVAVYYCWQGTHFPGTFGGGTKVEIK

SEQ ID NO: 226 - protein, 246 aa, Artificial Sequence
  source: /note="Description of Artificial Sequence: Synthetic polypeptide"
DVVMTQSPDSLAVSLGERATINCKSSQSLLDSDGKTYLNWLQQKPGQPPKRLISLVSKLDSGVPDRFSGSGSGTDFTLTISSLQAEDVAVYYCWQGTHFPGTFGGGTKVEIKGGGGSGGGGSGGGGSGGGGSEIQLVQSGAEVKKPGESLRISCKGSGFNIEDYYIHWVRQMPGKGLEWMGRIDPENDETKYGPIFQGHVTISADTSINTVYLQWSSLKASDTAMYYCAFRGGVYWGQGTTVTVSS

SEQ ID NO: 227 - protein, 246 aa, Artificial Sequence
  source: /note="Description of Artificial Sequence: Synthetic polypeptide"
DVVMTQSPLSLPVTLGQPASISCKSSQSLLDSDGKTYLNWLQQRPGQSPRRLISLVSKLDSGVPDRFSGSGSGTDFTLKISRVEAEDVGVYYCWQGTHFPGTFGGGTKVEIKGGGGSGGGGSGGGGSGGGGSEIQLVQSGAEVKKPGATVKISCKGSGFNIEDYYIHWVQQAPGKGLEWMGRIDPENDETKYGPIFQGRVTITADTSTNTVYMELSSLRSEDTAVYYCAFRGGVYWGQGTTVTVSS

SEQ ID NO: 228 - protein, 243 aa, Artificial Sequence
  source: /note="Description of Artificial Sequence: Synthetic polypeptide"
EIQLQQSGAELVKPGASVKLSCTGSGFNIEDYYIHWVKQRTEQGLEWIGRIDPENDETKYGPIFQGRATITADTSSNTVYLQLSSLTSEDTAVYYCAFRGGVYWGPGTTLTVSSGGGGSGGGGSGGGGSHMDVVMTQSPLTLSVAIGQSASISCKSSQSLLDSDGKTYLNWLLQRPGQSPKRLISLVSKLDSGVPDRFTGSGSGTDFTLRISRVEAEDLGIYYCWQGTHFPGTFGGGTKLEIK

SEQ ID NO: 229 - protein, 239 aa, Artificial Sequence
  source: /note="Description of Artificial Sequence: Synthetic polypeptide"
QVQLQQSGPELEKPGASVKISCKASGYSFTGYTMNWVKQSHGKSLEWIGLITPYNGASSYNQKFRGKATLTVDKSSSTAYMDLLSLTSEDSAVYFCARGGYDGRGFDYWGQGTTVTVSSGGGGSGGGGSGGGGSDIELTQSPAIMSASPGEKVTMTCSASSSVSYMHWYQQKSGTSPKRWIYDTSKLASGVPGRFSGSGSGNSYSLTISSVEAEDDATYYCQQWSGYPLTFGAGTKLEI

SEQ ID NO: 230 - protein, 244 aa, Artificial Sequence
  source: /note="Description of Artificial Sequence: Synthetic polypeptide"
QVQLQQSGAEVKKPGASVKVSCKASGYTFTGYYMHWVRQAPGQGLEWMGRINPNSGGTNYAQKFQGRVTMTRDTSISTAYMELSRLRSEDTAVYYCARGRYYGMDVWGQGTMVTVSSGGGGSGGGGSGGGGSGGGGSEIVLTQSPATLSLSPGERATISCRASQSVSSNFAWYQQRPGQAPRLLIYDASNRATGIPPRFSGSGSGTDFTLTISSLEPEDFAAYYCHQRSNWLYTFGQGTKVDIK

SEQ ID NO: 231 - protein, 253 aa, Artificial Sequence
  source: /note="Description of Artificial Sequence: Synthetic polypeptide"
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARDLRRTVVTPRAYYGMDVWGQGTTVTVSSGGGGSGGGGSGGGGSGGGGSDIQLTQSPSTLSASVGDRVTITCQASQDISNSLNWYQQKAGKAPKLLIYDASTLETGVPSRFSGSGSGTDFSFTISSLQPEDIATYYCQQHDNLPLTFGQGTKVEIK

SEQ ID NO: 232 - protein, 246 aa, Artificial Sequence
  source: /note="Description of Artificial Sequence: Synthetic polypeptide"
QVQLVQSGAEVKKPGAPVKVSCKASGYTFTGYYMHWVRQAPGQGLEWMGWINPNSGGTNYAQKFQGRVTMTRDTSISTAYMELSRLRSDDTAVYYCARGEWDGSYYYDYWGQGTLVTVSSGGGGSGGGGSGGGGSGGGGSDIVLTQTPSSLSASVGDRVTITCRASQSINTYLNWYQHKPGKAPKLLIYAASSLQSGVPSRFSGSGSGTDFTLTISSLQPEDFATYYCQQSFSPLTFGGGTKLEIK

SEQ ID NO: 233 - protein, 242 aa, Artificial Sequence
  source: /note="Description of Artificial Sequence: Synthetic polypeptide"
QVQLVESGGGLVQPGGSLRLSCAASGFTFSSYWMHWVRQVPGKGLVWVSRINTDGSTTTYADSVEGRFTISRDNAKNTLYLQMNSLRDDDTAVYYCVGGHWAVWGQGTTVTVSSGGGGSGGGGSGGGGSGGGGSDIQMTQSPSTLSASVGDRVTITCRASQSISDRLAWYQQKPGKAPKLLIYKASSLESGVPSRFSGSGSGTEFTLTISSLQPDDFAVYYCQQYGHLPMYTFGQGTKVEIK

SEQ ID NO: 234 - protein, 241 aa, Artificial Sequence
  source: /note="Description of Artificial Sequence: Synthetic polypeptide"
QVQLVQSGAEVEKPGASVKVSCKASGYTFTDYYMHWVRQAPGQGLEWMGWINPNSGGTNYAQKFQGRVTMTRDTSISTAYMELSRLRSDDTAVYYCASGWDFDYWGQGTLVTVSSGGGGSGGGGSGGGGSGGGGSDIVMTQSPSSLSASVGDRVTITCRASQSIRYYLSWYQQKPGKAPKLLIYTASILQNGVPSRFSGSGSGTDFTLTISSLQPEDFATYYCLQTYTTPDFGPGTKVEIK

SEQ ID NO: 235 - protein, 253 aa, Artificial Sequence
  source: /note="Description of Artificial Sequence: Synthetic polypeptide"
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARYRLIAVAGDYYYYGMDVWGQGTMVTVSSGGGGSGGGGSGGGGSGGGGSDIQMTQSPSSVSASVGDRVTITCRASQGVGRWLAWYQQKPGTAPKLLIYAASTLQSGVPSRFSGSGSGTDFTLTINNLQPEDFATYYCQQANSFPLTFGGGTRLEIK

SEQ ID NO: 236 - protein, 250 aa, Artificial Sequence
  source: /note="Description of Artificial Sequence: Synthetic polypeptide"
QVQLVQSGGGVVQPGRSLRLSCAASGFTFSSYAMHWVRQAPGKGLEWVAVISYDGSNKYYADSVKGRFTISRDNSKNTLYLQMNSLRAEDTAVYYCARWKVSSSSPAFDYWGQGTLVTVSSGGGGSGGGGSGGGGSGGGGSEIVLTQSPATLSLSPGERAILSCRASQSVYTKYLGWYQQKPGQAPRLLIYDASTRATGIPDRFSGSGSGTDFTLTINRLEPEDFAVYYCQHYGGSPLITFGQGTRLEIK

SEQ ID NO: 237 - protein, 246 aa, Artificial Sequence
  source: /note="Description of Artificial Sequence: Synthetic polypeptide"
QVQLQQSGAEVKKPGASVKVSCKTSGYPFTGYSLHWVRQAPGQGLEWMGWINPNSGGTNYAQKFQGRVTMTRDTSISTAYMELSRLRSDDTAVYYCARDHYGGNSLFYWGQGTLVTVSSGGGGSGGGGSGGGGSGGGGSDIQLTQSPSSISASVGDTVSITCRASQDSGTWLAWYQQKPGKAPNLLMYDASTLEDGVPSRFSGSASGTEFTLTVNRLQPEDSATYYCQQYNSYPLTFGGGTKVDIK

SEQ ID NO: 238 - protein, 248 aa, Artificial Sequence
  source: /note="Description of Artificial Sequence: Synthetic polypeptide"
QVQLVQSGAEVKKPGASVEVSCKASGYTFTSYYMHWVRQAPGQGLEWMGIINPSGGSTGYAQKFQGRVTMTRDTSTSTVHMELSSLRSEDTAVYYCARGGYSSSSDAFDIWGQGTMVTVSSGGGGSGGGGSGGGGSGGGGSDIQMTQSPPSLSASVGDRVTITCRASQDISSALAWYQQKPGTPPKLLIYDASSLESGVPSRFSGSGSGTDFTLTISSLQPEDFATYYCQQFSSYPLTFGGGTRLEIK

SEQ ID NO: 239 - protein, 255 aa, Artificial Sequence
  source: /note="Description of Artificial Sequence: Synthetic polypeptide"
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARVAGGIYYYYGMDVWGQGTTITVSSGGGGSGGGGSGGGGSGGGGSDIVMTQTPDSLAVSLGERATISCKSSHSVLYNRNNKNYLAWYQQKPGQPPKLLFYWASTRKSGVPDRFSGSGSGTDFTLTISSLQPEDFATYFCQQTQTFPLTFGQGTRLEIN

SEQ ID NO: 240 - protein, 241 aa, Artificial Sequence
  source: /note="Description of Artificial Sequence: Synthetic polypeptide"
QVQLQQSGAEVKKPGASVKVSCKASGYTFTGYYMHWVRQAPGQGLEWMGWINPNSGGTNYAQNFQGRVTMTRDTSISTAYMELRRLRSDDTAVYYCASGWDFDYWGQGTLVTVSSGGGGSGGGGSGGGGSGGGGSDIRMTQSPSSLSASVGDRVTITCRASQSIRYYLSWYQQKPGKAPKLLIYTASILQNGVPSRFSGSGSGTDFTLTISSLQPEDFATYYCLQTYTTPDFGPGTKVEIK

SEQ ID NO: 241 - protein, 246 aa, Artificial Sequence
  source: /note="Description of Artificial Sequence: Synthetic polypeptide"
QVQLVQSGAEVKKPGASVKVSCKASGYTFTGYYMHWVRQAPGQGLEWMGRINPNSGGTNYAQKFQGRVTMTTDTSTSTAYMELRSLRSDDTAVYYCARTTTSYAFDIWGQGTMVTVSSGGGGSGGGGSGGGGSGGGGSDIQLTQSPSTLSASVGDRVTITCRASQSISTWLAWYQQKPGKAPNLLIYKASTLESGVPSRFSGSGSGTEFTLTISSLQPDDFATYYCQQYNTYSPYTFGQGTKLEIK

SEQ ID NO: 242 - protein, 249 aa, Artificial Sequence
  source: /note="Description of Artificial Sequence: Synthetic polypeptide"
QVQLVQSGGGLVKPGGSLRLSCEASGFIFSDYYMGWIRQAPGKGLEWVSYIGRSGSSMYYADSVKGRFTFSRDNAKNSLYLQMNSLRAEDTAVYYCAASPVVAATEDFQHWGQGTLVTVSSGGGGSGGGGSGGGGSGGGGSDIVMTQTPATLSLSPGERATLSCRASQSVTSNYLAWYQQKPGQAPRLLLFGASTRATGIPDRFSGSGSGTDFTLTINRLEPEDFAMYYCQQYGSAPVTFGQGTKLEIK

SEQ ID NO: 243 - protein, 249 aa, Artificial Sequence
  source: /note="Description of Artificial Sequence: Synthetic polypeptide"
QVQLVQSGAEVRAPGASVKISCKASGFTFRGYYIHWVRQAPGQGLEWMGIINPSGGSRAYAQKFQGRVTMTRDTSTSTVYMELSSLRSDDTAMYYCARTASCGGDCYYLDYWGQGTLVTVSSGGGGSGGGGSGGGGSGGGGSDIQMTQSPPTLSASVGDRVTITCRASENVNIWLAWYQQKPGKAPKLLIYKSSSLASGVPSRFSGSGSGAEFTLTISSLQPDDFATYYCQQYQSYPLTFGGGTKVDIK

SEQ ID NO: 244 - protein, 244 aa, Artificial Sequence
  source: /note="Description of Artificial Sequence: Synthetic polypeptide"
QVQLVQSGGGLVQPGRSLRLSCAASGFTFDDYAMHWVRQAPGKGLEWVSGISWNSGSIGYADSVKGRFTISRDNAKNSLYLQMNSLRAEDTAVYYCAKDGSSSWSWGYFDYWGQGTLVTVSSGGGGSGGGGSGGGGSSSELTQDPAVSVALGQTVRTTCQGDALRSYYASWYQQKPGQAPMLVIYGKNNRPSGIPDRFSGSDSGDTASLTITGAQAEDEADYYCNSRDSSGYPVFGTGTKVTVL

SEQ ID NO: 245 - protein, 246 aa, Artificial Sequence
  source: /note="Description of Artificial Sequence: Synthetic polypeptide"
EVQLVESGGGLVQPGRSLRLSCAASGFTFDDYAMHWVRQAPGKGLEWVSGISWNSGSTGYADSVKGRFTISRDNAKNSLYLQMNSLRAEDTALYYCAKDSSSWYGGGSAFDIWGQGTMVTVSSGGGGSGGGGSGGGGSSSELTQEPAVSVALGQTVRITCQGDSLRSYYASWYQQKPGQAPVLVIFGRSRRPSGIPDRFSGSSSGNTASLIITGAQAEDEADYYCNSRDNTANHYVFGTGTKLTVL

SEQ ID NO: 246 - protein, 246 aa, Artificial Sequence
  source: /note="Description of Artificial Sequence: Synthetic polypeptide"
EVQLVESGGGLVQPGRSLRLSCAASGFTFDDYAMHWVRQAPGKGLEWVSGISWNSGSTGYADSVKGRFTISRDNAKNSLYLQMNSLRAEDTALYYCAKDSSSWYGGGSAFDIWGQGTMVTVSSGGGGSGGGGSGGGGSSSELTQDPAVSVALGQTVRITCQGDSLRSYYASWYQQKPGQAPVLVIYGKNNRPSGIPDRFSGSSSGNTASLTITGAQAEDEADYYCNSRGSSGNHYVFGTGTKVTVL

SEQ ID NO: 247 - protein, 251 aa, Artificial Sequence
  source: /note="Description of Artificial Sequence: Synthetic polypeptide"
QVQLVQSGGGLVQPGGSLRLSCAASGFTFSSYWMHWVRQAPGKGLVWVSRINSDGSSTSYADSVKGRFTISRDNAKNTLYLQMNSLRAEDTAVYYCVRTGWVGSYYYYMDVWGKGTTVTVSSGGGGSGGGGSGGGGSGGGGSEIVLTQSPGTLSLSPGERATLSCRASQSVSSNYLAWYQQKPGQPPRLLIYDVSTRATGIPARFSGGGSGTDFTLTISSLEPEDFAVYYCQQRSNWPPWTFGQGTKVEIK

SEQ ID NO: 248 - protein, 250 aa, Artificial Sequence
  source: /note="Description of Artificial Sequence: Synthetic polypeptide"
QVQLVQSGGGVVQPGRSLRLSCAASGFTFSSYGMHWVRQAPGKGLEWVAVISYDGSNKYYADSVKGRFTISRDNSKNTLYLQMNSLRAEDTAVYYCAKGYSRYYYYGMDVWGQGTTVTVSSGGGGSGGGGSGGGGSGGGGSEIVMTQSPATLSLSPGERAILSCRASQSVYTKYLGWYQQKPGQAPRLLIYDASTRATGIPDRFSGSGSGTDFTLTINRLEPEDFAVYYCQHYGGSPLITFGQGTKVDIK

SEQ ID NO: 249 - protein, 249 aa, Artificial Sequence
  source: /note="Description of Artificial Sequence: Synthetic polypeptide"
QVQLVQSGGGLVQPGGSLRLSCAASGFTFSSYAMSWVRQAPGKGLEWVSAISGSGGSTYYADSVKGRFTISRDNSKNTLYLQMNSLRAEDTAVYYCAKREAAAGHDWYFDLWGRGTLVTVSSGGGGSGGGGSGGGGSGGGGSDIRVTQSPSSLSASVGDRVTITCRASQSISSYLNWYQQKPGKAPKLLIYAASSLQSGVPSRFSGSGSGTDFTLTISSLQPEDFATYYCQQSYSIPLTFGQGTKVEIK

SEQ ID NO: 250 - protein, 247 aa, Artificial Sequence
  source: /note="Description of Artificial Sequence: Synthetic polypeptide"
QVQLVQSWAEVKKPGASVKVSCKASGYTFTSYYMHWVRQAPGQGLEWMGIINPSGGSTSYAQKFQGRVTMTRDTSTSTVYMELSNLRSEDTAVYYCARSPRVTTGYFDYWGQGTLVTVSSGGGGSGGGGSGGGGSGGGGSDIQLTQSPSTLSASVGDRVTITCRASQSISSWLAWYQQKPGKAPKLLIYKASSLESGVPSRFSGSGSGTEFTLTISSLQPDDFATYYCQQYSSYPLTFGGGTRLEIK

SEQ ID NO: 251 - protein, 253 aa, Artificial Sequence
  source: /note="Description of Artificial Sequence: Synthetic polypeptide"
QVQLVQSGAEVRRPGASVKISCRASGDTSTRHYIHWLRQAPGQGPEWMGVINPTTGPATGSPAYAQMLQGRVTMTRDTSTRTVYMELRSLRFEDTAVYYCARSVVGRSAPYYFDYWGQGTLVTVSSGGGGSGGGGSGGGGSGGGGSDIQMTQSPSSLSASVGDRVTITCRASQGISDYSAWYQQKPGKAPKLLIYAASTLQSGVPSRFSGSGSGTDFTLTISYLQSEDFATYYCQQYYSYPLTFGGGTKVDIK

SEQ ID NO: 252 - protein, 249 aa, Artificial Sequence
  source: /note="Description of Artificial Sequence: Synthetic polypeptide"
QVQLQQSGAEVKKPGASVKVSCKASGYTFTNYYMHWVRQAPGQGLEWMGIINPSGGYTTYAQKFQGRLTMTRDTSTSTVYMELSSLRSEDTAVYYCARIRSCGGDCYYFDNWGQGTLVTVSSGGGGSGGGGSGGGGSGGGGSDIQLTQSPSTLSASVGDRVTITCRASENVNIWLAWYQQKPGKAPKLLIYKSSSLASGVPSRFSGSGSGAEFTLTISSLQPDDFATYYCQQYQSYPLTFGGGTKVDIK

SEQ ID NO: 253 - protein, 246 aa, Artificial Sequence
  source: /note="Description of Artificial Sequence: Synthetic polypeptide"
QITLKESGPALVKPTQTLTLTCTFSGFSLSTAGVHVGWIRQPPGKALEWLALISWADDKRYRPSLRSRLDITRVTSKDQVVLSMTNMQPEDTATYYCALQGFDGYEANWGPGTLVTVSSGGGGSGGGGSGGGGSGGGGSDIVMTQSPSSLSASAGDRVTITCRASRGISSALAWYQQKPGKPPKLLIYDASSLESGVPSRFSGSGSGTDFTLTIDSLEPEDFATYYCQQSYSTPWTFGQGTKVDIK

SEQ ID NO: 254 - protein, 247 aa, Artificial Sequence
  source: /note="Description of Artificial Sequence: Synthetic polypeptide"
EVQLQQSGAEVKKPGSSVKVSCKASGGTFSSYAISWVRQAPGQGLEWMGGIIPIFGTANYAQKFQGRVTITADESTSTAYMELSSLRSEDTAVYYCARDLEMATIMGGYWGQGTLVTVSSGGGGSGGGGSGGGGSQSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTLDVVFGGGTKLTVL

SEQ ID NO: 255 - protein, 245 aa, Artificial Sequence
  source: /note="Description of Artificial Sequence: Synthetic polypeptide"
EVQLVESGGGVVQPGGSLRLSCAASGFTFDDYAMHWVRQAPGKGLEWVSLISGDGGSTYYADSVKGRFTISRDNSKNTLYLQMNSLRVEDTAVYYCARVFDSYYMDVWGKGTTVTVSSGGGGSGGGGSGSGGSEIVLTQSPLSLPVTPGQPASISCRSSQSLVYTDGNTYLNWFQQRPGQSPRRLIYKVSNRDSGVPDRFSGSGSDTDFTLKISRVEAEDVGIYYCMQGTHWSFTFGQGTRLEIK

SEQ ID NO: 256 - protein, 247 aa, Artificial Sequence
  source: /note="Description of Artificial Sequence: Synthetic polypeptide"
QVQLQESGPGLVKPSETLSLTCTVSGGSISSSSYYWGWIRQPPGKGLEWIGSIYYSGSTYYNPSLKSRVSISVDTSKNQFSLKLKYVTAADTAVYYCATPGTYYDFLSGYYPFYWGQGTLVTVSSGGGGSGGGGSGGGGSDIVMTQSPSSLSASVGDRVTITCRASQGISSYLAWYQQKPGKAPKLLIYAASTLQSGVPSRFSGSGSGTDFTLTISSLQPEDFATYYCQQLNSYPYTFGQGTKLEIK

SEQ ID NO: 257 - protein, 239 aa, Artificial Sequence
  source: /note="Description of Artificial Sequence: Synthetic polypeptide"
QVQLVESGGGLVQPGGSLRLSCAASGFTFSSYWMSWVRQAPGKGLEWVANINEDGSAKFYVDSVKGRFTISRDNAKNSLYLQMNSLRAEDTAVYFCARDLRSGRYWGQGTLVTVSSGGGGSGGGGSGGGGSEIVLTQSPGTLSLSPGGRATLSCRASQSISGSFLAWYQQKPGQAPRLLIYGASSRATGIPDRFSGSGSGTDFTLTISRLEPEDFAVYYCQQYGSSPPTFGLGTKLEIK

SEQ ID NO: 258 - protein, 245 aa, Artificial Sequence
  source: /note="Description of Artificial Sequence: Synthetic polypeptide"
EVQLQQSGPGLVRPSETLSLTCTVSGGPVRSGSHYWNWIRQPPGRGLEWIGYIYYSGSTNYNPSLENRVTISIDTSNNHFSLKLSSVTAADTALYFCARGTATFDWNFPFDSWGQGTLVTVSSGGGGSGGGGSGSGGSDIQMTQSPSSLSASIGDRVTITCRASQSISSYLNWYQQKPGKAPKLLIYAASSLQSGVPSRFSGSGSGTDFTLTISSLQPEDFATYYCQQSYSTPWTFGQGTKLEIK

SEQ ID NO: 259 - protein, 249 aa, Artificial Sequence
  source: /note="Description of Artificial Sequence: Synthetic polypeptide"
QVQLQESGAGLLKPSETLSLTCAVYGGSFSGYYWSWIRQPPGKGLEWVGEINHSGSTNYNPSLKSRVTISVDTSKNQFSLKLSSVTAADTAVYYCARGSGLVVYAIRVGSGWFDYWGQGTLVTVSSGGGGSGGGDSGGGGSDIQMTQSPSSLSASVGDRVTITCRASQSISSYLNWYQQKPGKAPKLLMYAASSLQSGVPSRFSGSGSGTDFTLTISSLQPEDFATYYCQQSYSTPPWTFGQGTKVDIK

SEQ ID NO: 260 - protein, 255 aa, Artificial Sequence
  source: /note="Description of Artificial Sequence: Synthetic polypeptide"
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARDPSSSGSYYMEDSYYYGMDVWGQGTTVTVSSGGGGSGGGGSGGGGSNFMLTQPHSVSESPGKTVTISCTGSSGSIASNYVQWYQQRPGSAPTTVIYEDNQRPSGVPDRFSGSIDSSSNSASLTISGLKTEDEADYYCQSYDSSNQVVFGGGTKLTVL

SEQ ID NO: 261 - protein, 239 aa, Artificial Sequence
  source: /note="Description of Artificial Sequence: Synthetic polypeptide"
QVNLRESGGGLVQPGGSLRLSCAASGFTFSSYEMNWVRQAPGKGLEWVSYISSSGSTIYYADSVKGRFTISRDNAKNSLYLQMNSLRAEDTAVYYCAREALGSSWEWGQGTTVTVSSGGGGSGGGGSGGGGSDIQMTQSPSSLSASVGDRVTITCQASQDISNYLNWYQQKPGKAPKLLIYDASNLETGVPSRFSGSGSGTDFTFTISSLQPEDIATYYCQQYDNLPLTFGGGTKLEIK

SEQ ID NO: 262 - protein, 246 aa, Artificial Sequence
  source: /note="Description of Artificial Sequence: Synthetic polypeptide"
QVQLVQSGAEVKEPGASVKVSCKAPANTFSDHVMHWVRQAPGQRFEWMGYIHAANGGTHYSQKFQDRVTITRDTSANTVYMDLSSLRSEDTAVYYCARGGYNSDAFDIWGQGTMVTVSSGGGGSGGGGSGGGGSGGGGSDIVMTQSPSSVSASVGDRVTITCRASQDISSWLAWYQQKPGKAPKLLIYAASSLQSGVPSRFNGSGSGTDFTLTISSLQPEDFATYYCQQSYSTPLTFGGGTKVEIK

SEQ ID NO: 263 - protein, 248 aa, Artificial Sequence
  source: /note="Description of Artificial Sequence: Synthetic polypeptide"
QVQLVQSGGGLVQPGGSLRLSCAASGFTFSSYSMNWVRQAPGKGLEWVSYISSSSSTIYYADSVKGRFTISRDNAKNSLYLQMNSLRAEDTAVYYCARDLSVRAIDAFDIWGQGTMVTVSSGGGGSGGGGSGGGGSGGGGSDIVLTQSPSSLSASVGDRVTITCQASQDISNYLNWYQQKPGKAPKLLIYDASNLETGVPSRFSGSGSGTDFTFTISSLQPEDFATYYCQQAYSTPFTFGPGTKVEIK

SEQ ID NO: 264 - protein, 246 aa, Artificial Sequence
  source: /note="Description of Artificial Sequence: Synthetic polypeptide"
EVQLVQSGGGVVRSGRSLRLSCAASGFTFNSYGLHWVRQAPGKGLEWVALIEYDGSNKYYGDSVKGRFTISRDKSKSTLYLQMDNLRAEDTAVYYCAREGNEDLAFDIWGQGTLVTVSSGGGGSGGGGSGGGGSGGGGSEIVLTQSPSSLSASVGDRVTITCQASQFIKKNLNWYQHKPGKAPKLLIYDASSLQTGVPSRFSGNRSGTTFSFTISSLQPEDVATYYCQQHDNLPLTFGGGTKVEIK

SEQ ID NO: 265 - protein, 255 aa, Artificial Sequence
  source: /note="Description of Artificial Sequence: Synthetic polypeptide"
QVQLVESGGGLVQPGGSLRLSCAASGFNVSSNYMTWVRQAPGKGLEWVSVIYSGGATYYGDSVKGRFTVSRDNSKNTVYLQMNRLTAEDTAVYYCARDRLYCGNNCYLYYYYGMDVWGQGTLVTVSSGGGGSGGGGSGGGGSGGGGSDIQVTQSPSSLSASVGDRVTITCRASQSISSYLNWYQQKPGKAPKLLIYAASSLQSGVPSRFSGSGSGTDFTLTISSLQPEDFATYYCQQSYSTPPLTFGQGTKVEIK

SEQ ID NO: 266 - protein, 247 aa, Artificial Sequence
  source: /note="Description of Artificial Sequence: Synthetic polypeptide"
QVQLVQSGAEVKKSGASVKVSCKASGYPFTGYYIQWVRQAPGQGLEWMGWIDPNSGNTGYAQKFQGRVTMTRNTSISTAYMELSSLRSEDTAVYYCASDSYGYYYGMDVWGQGTLVTVSSGGGGSGGGGSGGGGSGGGGSDIQMTQSPSSLSASVGDRVTFTCRASQGISSALAWYQQKPGKPPKLLIYDASSLESGVPSRFSGSGSGTDFTLTISSLQPEDFATYYCQQFNNYPLTFGGGTKVEIK

SEQ ID NO: 267 - protein, 245 aa, Artificial Sequence
  source: /note="Description of Artificial Sequence: Synthetic polypeptide"
EVQLVESGGGLVQPGGSLRLSCAASGFTFSSYEMNWVRQAPGKGLEWVSYISSSGSTIYYADSVKGRFTISRDNAKNSLYLQMNSLRAEDTAVYYCARDPYSSSWHDAFDIWGQGTMVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVDIK

SEQ ID NO: 268 - protein, 246 aa, Artificial Sequence
  source: /note="Description of Artificial Sequence: Synthetic polypeptide"
QVQLVESGGGLVQPGRSLRLSCAASGFTFSNYAMSWVRQAPGKGLGWVSGISRSGENTYYADSVKGRFTISRDNSKNTLYLQMNSLRDEDTAVYYCARSPAHYYGGMDVWGQGTTVTVSSASGGGGSGGRASGGGGSDIVLTQSPGTLSLSPGERATLSCRASQSISSSFLAWYQQKPGQAPRLLIYGASRRATGIPDRFSGSGSGTDFTLTISRLEPEDSAVYYCQQYHSSPSWTFGQGTKLEIK

SEQ ID NO: 269 - protein, 244 aa, Artificial Sequence
  source: /note="Description of Artificial Sequence: Synthetic polypeptide"
QVQLVESGGGLVQPGRSLRLSCAASGFTFDDYAMHWVRQAPGKGLEWVSGISWNSGSIGYADSVKGRFTISRDNAKNSLYLQMNSLRAEDTALYYCSVHSFLAYWGQGTLVTVSSASGGGGSGGRASGGGGSDIVMTQTPLSLPVTPGEPASISCRSSQSLLHSNGYNYLDWYLQKPGQSPQLLIYLGSNRASGVPDRFSGSGSGTDFTLKISRVEAEDVGVYYCMQALQTPYTFGQGTKVEIK

SEQ ID NO: 270 - protein, 243 aa, Artificial Sequence
  source: /note="Description of Artificial Sequence: Synthetic polypeptide"
EVQLLESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSDIVMTQTPLSLSVTPGQPASISCKSSQSLLRNDGKTPLYWYLQKAGQPPQLLIYEVSNRFSGVPDRFSGSGSGTDFTLKISRVEAEDVGAYYCMQNIQFPSFGGGTKLEIK

SEQ ID NO: 271 - protein, 249 aa, Artificial Sequence
  source: /note="Description of Artificial Sequence: Synthetic polypeptide"
QVQLVQSGAEVRKTGASVKVSCKASGYIFDNFGINWVRQAPGQGLEWMGWINPKNNNTNYAQKFQGRVTITADESTNTAYMEVSSLRSEDTAVYYCARGPYYYQSYMDVWGQGTMVTVSSASGGGGSGGRASGGGGSDIVMTQTPLSLPVTPGEPASISCRSSQSLLHSNGYNYLNWYLQKPGQSPQLLIYLGSKRASGVPDRFSGSGSGTDFTLHITRVGAEDVGVYYCMQALQTPYTFGQGTKLEIK

SEQ ID NO: 272 - protein, 246 aa, Artificial Sequence
  source: /note="Description of Artificial Sequence: Synthetic polypeptide"
QVQLQESGGGLVQPGGSLRLSCAASGFTFSSDAMTWVRQAPGKGLEWVSVISGSGGTTYYADSVKGRFTISRDNSKNTLYLQMNSLRAEDTAVYYCAKLDSSGYYYARGPRYWGQGTLVTVSSASGGGGSGGRASGGGGSDIQLTQSPSSLSASVGDRVTITCRASQSISSYLNWYQQKPGKAPKLLIYGASTLASGVPARFSGSGSGTHFTLTINSLQSEDSATYYCQQSYKRASFGQGTKVEIK

SEQ ID NO: 273 - protein, 247 aa, Artificial Sequence
  source: /note="Description of Artificial Sequence: Synthetic polypeptide"
QVQLVQSGAEVKKPGASVKVSCKASGYTFSNYGITWVRQAPGQGLEWMGWISAYNGNTNYAQKFQGRVTMTRNTSISTAYMELSSLRSEDTAVYYCARGPYYYYMDVWGKGTMVTVSSASGGGGSGGRASGGGGSEIVMTQSPLSLPVTPGEPASISCRSSQSLLYSNGYNYVDWYLQKPGQSPQLLIYLGSNRASGVPDRFSGSGSGTDFKLQISRVEAEDVGIYYCMQGRQFPYSFGQGTKVEIK

SEQ ID NO: 274 - protein, 238 aa, Artificial Sequence
  source: /note="Description of Artificial Sequence: Synthetic polypeptide"
EVQLLETGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSEIVLTQSPATLSVSPGESATLSCRASQSVSSNLAWYQQKPGQAPRLLIYGASTRASGIPDRFSGSGSGTDFTLTISSLQAEDVAVYYCQQYGSSLTFGGGTKVEIK

SEQ ID NO: 275 - protein, 239 aa, Artificial Sequence
  source: /note="Description of Artificial Sequence: Synthetic polypeptide"
EVQLVETGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSEIVMTQSPATLSVSPGERATLSCRASQSVSSKLAWYQQKPGQAPRLLMYGASIRATGIPDRFSGSGSGTEFTLTISSLEPEDFAVYYCQQYGSSSWTFGQGTKVEIK

SEQ ID NO: 276 - protein, 241 aa, Artificial Sequence
  source: /note="Description of Artificial Sequence: Synthetic polypeptide"
EVQLVETGGGVVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSEIVLTQSPGTLSLSPGERATLSCRASQSVGSTNLAWYQQKPGQAPRLLIYDASNRATGIPDRFSGGGSGTDFTLTISRLEPEDFAVYYCQQYGSSPPWTFGQGTKVEIK

SEQ ID NO: 277 - protein, 239 aa, Artificial Sequence
  source: /note="Description of Artificial Sequence: Synthetic polypeptide"
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARESGDGMDVWGQGTTVTVSSASGGGGSGGRASGGGGSDIQMTQSPSSLSASVGDRVTITCRASQSISSYLNWYQQKPGKAPKLLIYAASSLQSGVPSRFSGSGSGTDFTLTISSLQPEDFATYYCQQSYTLAFGQGTKVDIK

SEQ ID NO: 278 - protein, 239 aa, Artificial Sequence
  source: /note="Description of Artificial Sequence: Synthetic polypeptide"
EVQLVESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSDIQLTQSPSSLSASVGDRVTITCRASQSISSYLNWYQQKPGKAPKLLIYAASSLQSGVPSRFSGSGSGTDFTLTISSLQPEDFATYYCQQSYSTPYTFGQGTKVEIK

SEQ ID NO: 279 - protein, 246 aa, Artificial Sequence
  source: /note="Description of Artificial Sequence: Synthetic polypeptide"
QVQLVQSGGGLVKPGGSLRLSCAASGFTFSDYYMSWIRQAPGKGLEWVSYISSSGNTIYYADSVKGRFTISRDNAKNSLYLQMNSLRAEDTAVYYCARSTMVREDYWGQGTLVTVSSASGGGGSGGRASGGGGSDIVLTQSPLSLPVTLGQPASISCKSSESLVHNSGKTYLNWFHQRPGQSPRRLIYEVSNRDSGVPDRFTGSGSGTDFTLKISRVEAEDVGVYYCMQGTHWPGTFGQGTKLEIK

SEQ ID NO: 280 - protein, 239 aa, Artificial Sequence
  source: /note="Description of Artificial Sequence: Synthetic polypeptide"
QVQLVESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSDIRLTQSPSPLSASVGDRVTITCQASEDINKFLNWYHQTPGKAPKLLIYDASTLQTGVPSRFSGSGSGTDFTLTINSLQPEDIGTYYCQQYESLPLTFGGGTKVEIK

SEQ ID NO: 281 - protein, 240 aa, Artificial Sequence
  source: /note="Description of Artificial Sequence: Synthetic polypeptide"
EVQLVETGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSETTLTQSPATLSVSPGERATLSCRASQSVGSNLAWYQQKPGQGPRLLIYGASTRATGIPARFSGSGSGTEFTLTISSLQPEDFAVYYCQQYNDWLPVTFGQGTKVEIK

SEQ ID NO: 282 - protein, 241 aa, Artificial Sequence
  source: /note="Description of Artificial Sequence: Synthetic polypeptide"
EVQLVESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSEIVLTQSPGTLSLSPGERATLSCRASQSIGSSSLAWYQQKPGQAPRLLMYGASSRASGIPDRFSGSGSGTDFTLTISRLEPEDFAVYYCQQYAGSPPFTFGQGTKVEIK

SEQ ID NO: 283 - protein, 243 aa, Artificial Sequence
  source: /note="Description of Artificial Sequence: Synthetic polypeptide"
QVQLQESGPGLVKPSETLSLTCTVSGGSISSSYYYWGWIRQPPGKGLEWIGSIYYSGSAYYNPSLKSRVTISVDTSKNQFSLRLSSVTAADTAVYYCARHWQEWPDAFDIWGQGTMVTVSSGGGGSGGGGSGGGGSETTLTQSPAFMSATPGDKVIISCKASQDIDDAMNWYQQKPGEAPLFIIQSATSPVPGIPPRFSGSGFGTDFSLTINNIESEDAAYYFCLQHDNFPLTFGQGTKLEIK

SEQ ID NO: 284 - protein, 244 aa, Artificial Sequence
  source: /note="Description of Artificial Sequence: Synthetic polypeptide"
VNLRESGPALVKPTQTLTLTCTFSGFSLRTSGMCVSWIRQPPGKALEWLARIDWDEDKFYSTSLKTRLTISKDTSDNQVVLRMTNMDPADTATYYCARSGAGGTSATAFDIWGPGTMVTVSSGGGGSGGGGSGGGGSDIQMTQSPSSLSASVGDRVTITCRASQDIYNNLAWFQLKPGSAPRSLMYAANKSQSGVPSRFSGSASGTDFTLTISSLQPEDFATYYCQHYYRFPYSFGQGTKLEIK

SEQ ID NO: 285 - protein, 246 aa, Artificial Sequence
  source: /note="Description of Artificial Sequence: Synthetic polypeptide"
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCAKTIAAVYAFDIWGQGTTVTVSSGGGGSGGGGSGGGGSEIVLTQSPLSLPVTPEEPASISCRSSQSLLHSNGYNYLDWYLQKPGQSPQLLIYLGSNRASGVPDRFSGSGSGTDFTLKISRVEAEDVGVYYCMQALQTPYTFGQGTKLEIK

SEQ ID NO: 286 - protein, 240 aa, Artificial Sequence
  source: /note="Description of Artificial Sequence: Synthetic polypeptide"
EVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDLRGAFDIWGQGTMVTVSSGGGGSGGGGSGGGGSSYVLTQSPSVSAAPGYTATISCGGNNIGTKSVHWYQQKPGQAPLLVIRDDSVRPSKIPGRFSGSNSGNMATLTISGVQAGDEADFYCQVWDSDSEHVVFGGGTKLTVL

SEQ ID NO: 287 - protein, 241 aa, Artificial Sequence
  source: /note="Description of Artificial Sequence: Synthetic polypeptide"
QVQLVQSGAEVKKPGASVKVSCKPSGYTVTSHYIHWVRRAPGQGLEWMGMINPSGGVTAYSQTLQGRVTMTSDTSSSTVYMELSSLRSEDTAMYYCAREGSGSGWYFDFWGRGTLVTVSSGGGGSGGGGSGGGGSSYVLTQPPSVSVSPGQTASITCSGDGLSKKYVSWYQQKAGQSPVVLISRDKERPSGIPDRFSGSNSADTATLTISGTQAMDEADYYCQAWDDTTVVFGGGTKLTVL

SEQ ID NO: 288 - protein, 245 aa, Artificial Sequence
  source: /note="Description of Artificial Sequence: Synthetic polypeptide"
QVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCARAGIAARLRGAFDIWGQGTMVTVSSGGGGSGGGGSGGGGSDIVMTQSPSSVSASVGDRVIITCRASQGIRNWLAWYQQKPGKAPNLLIYAASNLQSGVPSRFSGSGSGADFTLTISSLQPEDVATYYCQKYNSAPFTFGPGTKVDIK

SEQ ID NO: 289 - protein, 253 aa, Artificial Sequence
  source: /note="Description of Artificial Sequence: Synthetic polypeptide"
QVQLVQSGAEVKKPGSSVKVSCKASGGTFSSYAISWVRQAPGQGLEWMGGIIPIFGTANYAQKFQGRVTITADESTSTAYMELSSLRSEDTAVYYCARRGGYQLLRWDVGLLRSAFDIWGQGTMVTVSSGGGGSGGGGSGGGGSSYVLTQPPSVSVAPGQTARITCGGNNIGSKSVHWYQQKPGQAPVLVLYGKNNRPSGVPDRFSGSRSGTTASLTITGAQAEDEADYYCSSRDSSGDHLRVFGTGTKVTVL

SEQ ID NO: 290 - protein, 248 aa, Artificial Sequence
  source: /note="Description of Artificial Sequence: Synthetic polypeptide"
EVQLQQSGPGLVKPSQTLSLTCAISGDSVSSNSAAWNWIRQSPSRGLEWLGRTYYRSKWYSFYAISLKSRIIINPDTSKNQFSLQLKSVTPEDTAVYYCARSSPEGLFLYWFDPWGQGTLVTVSSGGDGSGGGGSGGGGSSSELTQDPAVSVALGQTIRITCQGDSLGNYYATWYQQKPGQAPVLVIYGTNNRPSGIPDRFSASSSGNTASLTITGAQAEDEADYYCNSRDSSGHHLLFGTGTKVTVL

SEQ ID NO: 291 - protein, 246 aa, Artificial Sequence
  source: /note="Description of Artificial Sequence: Synthetic polypeptide"
EVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKVEGSGSLDYWGQGTLVTVSSGGGGSGGGGSGGGGSEIVMTQSPGTLSLSPGERATLSCRASQSVSSAYLAWYQQKPGQPPRLLISGASTRATGIPDRFGGSGSGTDFTLTISRLEPEDFAVYYCQHYGSSFNGSSLFTFGQGTRLEIK

SEQ ID NO: 292 - protein, 241 aa, Artificial Sequence
  source: /note="Description of Artificial Sequence: Synthetic polypeptide"
EVQLVETGGGLVQPGGSLRLSCAASGITFSRYPMSWVRQAPGKGLEWVSGISDSGVSTYYADSAKGRFTISRDNSKNTLFLQMSSLRDEDTAVYYCVTRAGSEASDIWGQGTMVTVSSGGGGSGGGGSGGGGSEIVLTQSPATLSLSPGERATLSCRASQSVSNSLAWYQQKPGQAPRLLIYDASSRATGIPDRFSGSGSGTDFTLTISRLEPEDFAIYYCQQFGTSSGLTFGGGTKLEIK

SEQ ID NO: 293 - protein, 248 aa, Artificial Sequence
  source: /note="Description of Artificial Sequence: Synthetic polypeptide"
QVQLVESGGGLVQPGGSLRLSCAASGFTFSSYAMSWVRQAPGKGLEWVSAISGSGGSTYYADSVKGRFTISRDNAKNSLYLQMNSLRAEDTAIYYCARATYKRELRYYYGMDVWGQGTMVTVSSGGGGSGGGGSGGGGSEIVMTQSPGTVSLSPGERATLSCRASQSVSSSFLAWYQQKPGQAPRLLIYGASSRATGIPDRFSGSGSGTDFTLTISRLEPEDSAVYYCQQYHSSPSWTFGQGTRLEIK

SEQ ID NO: 294 - protein, 248 aa, Artificial Sequence
  source: /note="Description of Artificial Sequence: Synthetic polypeptide"
EVQLVETGGGLVQPGGSLRLSCAASGFTFSSYAMSWVRQAPGKGLEWVSAISGSGGSTYYADSVKGRFTISRDNSKNTLYLQMNTLKAEDTAVYYCARATYKRELRYYYGMDVWGQGTTVTVSSGGGGSGGGGSGGGGSEIVLTQSPSTLSLSPGESATLSCRASQSVSTTFLAWYQQKPGQAPRLLIYGSSNRATGIPDRFSGSGSGTDFTLTIRRLEPEDFAVYYCQQYHSSPSWTFGQGTKVEIK

SEQ ID NO: 295 - protein, 239 aa, Artificial Sequence
  source: /note="Description of Artificial Sequence: Synthetic polypeptide"
EVQLVETGGGLVQPGRSLRLSCAASGFTFDDYAMHWVRQAPGKGLEWVSGISWNSGSIGYADSVKGRFTISRDNAKNSLYLQMNSLRDEDTAVYYCARVGKAVPDVWGQGTTVTVSSGGGGSGGGGSGGGGSDIVMTQTPSSLSASVGDRVTITCRASQSISSYLNWYQQKPGKAPKLLIYAASSLQSGVPSRFSGSGSGTDFTLTISSLQPEDFATYYCQQSYSTPYSFGQGTRLEIK

SEQ ID NO: 296 - protein, 246 aa, Artificial Sequence
  source: /note="Description of Artificial Sequence: Synthetic polypeptide"
EVQLVESGGGLVQPGRSLRLSCTASGFTFDDYAMHWVRQRPGKGLEWVASINWKGNSLAYGDSVKGRFAISRDNAKNTVFLQMNSLRTEDTAVYYCASHQGVAYYNYAMDVWGRGTLVTVSSGGGGSGGGGSGGGGSEIVLTQSPGTLSLSPGERATLSCRATQSIGSSFLAWYQQRPGQAPRLLIYGASQRATGIPDRFSGRGSGTDFTLTISRVEPEDSAVYYCQHYESSPSWTFGQGTKVEIK

SEQ ID NO: 297 - protein, 241 aa, Artificial Sequence
  source: /note="Description of Artificial Sequence: Synthetic polypeptide"
EVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKVVRDGMDVWGQGTTVTVSSGGGGSGGGGSGGGGSEIVLTQSPATLSLSPGERATLSCRASQSVSSSYLAWYQQKPGQAPRLLIYGASSRATGIPDRFSGNGSGTDFTLTISRLEPEDFAVYYCQQYGSPPRFTFGPGTKVDIK

SEQ ID NO: 298 - protein, 242 aa, Artificial Sequence
  source: /note="Description of Artificial Sequence: Synthetic polypeptide"
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKIPQTGTFDYWGQGTLVTVSSGGGGSGGGGSGGGGSEIVLTQSPGTLSLSPGERATLSCRASQSVSSSYLAWYQQRPGQAPRLLIYGASSRATGIPDRFSGSGSGTDFTLTISRLEPEDFAVYYCQHYGSSPSWTFGQGTRLEIK

SEQ ID NO: 299 - protein, 248 aa, Artificial Sequence
  source: /note="Description of Artificial Sequence: Synthetic polypeptide"
EVQLVETGGGLVQPGGSLRLSCAASGFTFSSYAMSWVRQAPGKGLEWVSAISGSGGSTYYADSVKGRFTMSRENDKNSVFLQMNSLRVEDTGVYYCARANYKRELRYYYGMDVWGQGTMVTVSSGGGGSGGGGSGGGGSEIVMTQSPGTLSLSPGESATLSCRASQRVASNYLAWYQHKPGQAPSLLISGASSRATGVPDRFSGSGSGTDFTLAISRLEPEDSAVYYCQHYDSSPSWTFGQGTKVEIK

SEQ ID NO: 300 - protein, 244 aa, Artificial Sequence
  source: /note="Description of Artificial Sequence: Synthetic polypeptide"
EVQLLETGGGLVQPGGSLRLSCAASGFSFSSYAMSWVRQAPGKGLEWVSAISGSGGSTYYADSVKGRFTISRDNSKNTLYLQMNSLRAEDTAVYYCAKALVGATGAFDIWGQGTLVTVSSGGGGSGGGGSGGGGSEIVLTQSPGTLSLSPGERATLSCRASQSLSSNFLAWYQQKPGQAPGLLIYGASNWATGTPDRFSGSGSGTDFTLTITRLEPEDFAVYYCQYYGTSPMYTFGQGTKVEIK

SEQ ID NO: 301 - protein, 244 aa, Artificial Sequence
  source: /note="Description of Artificial Sequence: Synthetic polypeptide"
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCVLWFGEGFDPWGQGTLVTVSSGGGGSGGGGSGGGGSDIVLTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPLTFGGGTKVDIK

SEQ ID NO: 302 - protein, 251 aa, Artificial Sequence
  source: /note="Description of Artificial Sequence: Synthetic polypeptide"
QVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKVGYDSSGYYRDYYGMDVWGQGTTVTVSSGGGGSGGGGSGGGGSEIVLTQSPGTLSLSPGERATLSCRASQSVSSSYLAWYQQKPGQAPRLLIYGTSSRATGISDRFSGSGSGTDFTLTISRLEPEDFAVYYCQHYGNSPPKFTFGPGTKLEIK

SEQ ID NO: 303 - protein, 246 aa, Artificial Sequence
  source: /note="Description of Artificial Sequence: Synthetic polypeptide"
EVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKMGWSSGYLGAFDIWGQGTTVTVSSGGGGSGGGGSGGGGSEIVLTQSPGTLSLSPGERATLSCRASQSVASSFLAWYQQKPGQAPRLLIYGASGRATGIPDRFSGSGSGTDFTLTISRLEPEDFAVYYCQHYGGSPRLTFGGGTKVDIK

SEQ ID NO: 304 - protein, 249 aa, Artificial Sequence
  source: /note="Description of Artificial Sequence: Synthetic polypeptide"
QVQLVQSGAEVKKPGSSVKVSCKASGGTFSNYWMHWVRQAPGQGLEWMGATYRGHSDTYYNQKFKGRVTITADKSTSTAYMELSSLRSEDTAVYYCARGAIYNGYDVLDNWGQGTLVTVSSGGGGSGGGGSGGGGSGGGGSDIQMTQSPSSLSASVGDRVTITCSASQDISNYLNWYQQKPGKAPKLLIYYTSNLHSGVPSRFSGSGSGTDFTLTISSLQPEDFATYYCQQYRKLPWTFGQGTKLEIKR

SEQ ID NO: 305 - protein, 249 aa, Artificial Sequence
  source: /note="Description of Artificial Sequence: Synthetic polypeptide"
DIQMTQSPSSLSASVGDRVTITCSASQDISNYLNWYQQKPGKAPKLLIYYTSNLHSGVPSRFSGSGSGTDFTLTISSLQPEDFATYYCQQYRKLPWTFGQGTKLEIKRGGGGSGGGGSGGGGSGGGGSQVQLVQSGAEVKKPGSSVKVSCKASGGTFSNYWMHWVRQAPGQGLEWMGATYRGHSDTYYNQKFKGRVTITADKSTSTAYMELSSLRSEDTAVYYCARGAIYNGYDVLDNWGQGTLVTVSS

SEQ ID NO: 306 - protein, 250 aa, Artificial Sequence
  source: /note="Description of Artificial Sequence: Synthetic polypeptide"
QVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARLGGSLPDYGMDVWGQGTMVTVSSASGGGGSGGGGSGGGGSEIVLTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTLITFGQGTKVDIK

SEQ ID NO: 307 - protein, 251 aa, Artificial Sequence
  source: /note="Description of Artificial Sequence: Synthetic polypeptide"
QVQLVQSGAEVKKPGASVRVSCKASGYIFTNYYVHWVRQAPGQGLEWMGIISPSGGSPTYAQRLQGRVTMTRDLSTSTVYMELSSLTSEDTAVYFCARESRLRGNRLGLQSSIFDHWGQGTLVTVSSASGGGGSGGGGSGGGGSDIRMTQSPPSLSASVGDRVTIPCQASQDINNHLNWYQQKPGKAPQLLIYDTSNLEIGVPSRFSGSGSGTDFTLTISSLQPEDIATYYCQQYENLPLTFGGGTKVEIK

SEQ ID NO: 308 - protein, 249 aa, Artificial Sequence
  source: /note="Description of Artificial Sequence: Synthetic polypeptide"
QVQLVQSGGGLVQPGGSLRLSCAASGFTFSSYAMSWVRQAPGKGLEWVSAISGSGGSTYYADSVKGRFTISRDNSKNTLYLQMNSLRAEDTAVYYCAKEDTIRGPNYYYYGMDVWGQGTTVTVSSASGGGGSGGGGSGGGGSETTLTQSPSSVSASVGDRVSITCRASQDIDTWLAWYQLKPGKAPKLLMYAASNLQGGVPSRFSGSGSGTDFILTISSLQPEDFATYYCQQASIFPPTFGGGTKVDIK

SEQ ID NO: 309 - protein, 250 aa, Artificial Sequence
  source: /note="Description of Artificial Sequence: Synthetic polypeptide"
QVQLVQSGAEVKKPGESLKISCKGSGYSFTSYWIGWVRQMPGKGLEWMGIIYPGDSDTRYSPSFQGQVTISADKSITTAYLQWSSLRASDSAMYYCARGGYSDYDYYFDFWGQGTLVTVSSASGGGGSGGGGSGGGGSEIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPFTFGGGTKVEIK

SEQ ID NO: 310 - protein, 240 aa, Artificial Sequence
  source: /note="Description of Artificial Sequence: Synthetic polypeptide"
QVQLVQSGGDLAQPGRSLRLSCAASGFTFDDYAMHWVRQAPGKGLEWVAVIWPDGGQKYYGDSVKGRFTVSRDNPKNTLYLQMNSLRAEDTAIYYCVRHFNAWDYWGQGTLVTVSSASGGGGSGGGGSGGGGSDIQLTQSPSSLSAYVGGRVTITCQASQGISQFLNWFQQKPGKAPKLLISDASNLEPGVPSRFSGSGSGTDFTFTITNLQPEDIATYYCQQYDDLPLTFGGGTKVEIK

SEQ ID NO: 311 - protein, 248 aa, Artificial Sequence
  source: /note="Description of Artificial Sequence: Synthetic polypeptide"
QVQLVQSGGGVVQPGKSLRLSCAASGFTFSIFAMHWVRQAPGKGLEWVATISYDGSNAFYADSVEGRFTISRDNSKDSLYLQMDSLRPEDTAVYYCVKAGDGGYDVFDSWGQGTLVTVSSASGGGGSGGGGSGGGGSEIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPTFGPGTKVDIK

SEQ ID NO: 312 - protein, 245 aa, Artificial Sequence
  source: /note="Description of Artificial Sequence: Synthetic polypeptide"
EVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKETDYYGSGTFDYWGQGTLVTVSSASGGGGSGGGGSGGGGSDIQMTQSPSSLSASVGDRVTISCRASQGIGIYLAWYQQRSGKPPQLLIHGASTLQSGVPSRFSGSGSGTDFTLTISSLQPEDFASYWCQQSNNFPPTFGQGTKVEIK

SEQ ID NO: 313 - protein, 245 aa, Artificial Sequence
  source: /note="Description of Artificial Sequence: Synthetic polypeptide"
QVQLVQSGAEVKKPGASVRVSCKASGYMFTDFFIHWVRQAPGQGLEWMGWINPNSGVTKYAQKFQGRVTMTRNTSISTAYMELSSLRSEDTAVYYCATWYSSGWYGIANIWGQGTMVTVSSASGGGGSGGGGSGGGGSDIQLTQSPSSLSASVGDRVTITCQASHDISNYLHWYQQKPGKAPKLLIYDASNLETGVPSRFTGSGSGTDFTLTIRSLQPEDVAAYYCQQSDDLPHTFGQGTKVDIK

SEQ ID NO: 314 - protein, 244 aa, Artificial Sequence
  source: /note="Description of Artificial Sequence: Synthetic polypeptide"
QVQLVQSGAEVKKPGESLKISCKGSGYSFTNYWIGWVRQMPGKGLEWMGIIYPGDSDTRYSPSFQGQVTISADKSISTAYLQWSSLKASDTAMYYCARHGPSSWGEFDYWGQGTLVTVSSASGGGGSGGGGSGGGGSDIRLTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVDIK

SEQ ID NO: 315 - protein, 246 aa, Artificial Sequence
  source: /note="Description of Artificial Sequence: Synthetic polypeptide"
NIMLTQSPSSLAVSAGEKVTMSCKSSQSVFFSSSQKNYLAWYQQIPGQSPKLLIYWASTRESGVPDRFTGSGSGTDFTLTISSVQSEDLAIYYCHQYLSSRTFGGGTKLEIKRGGGGSGGGGSSGGGSQVQLQQPGAEVVKPGASVKMSCKASGYTFTSYYIHWIKQTPGQGLEWVGVIYPGNDDISYNQKFKGKATLTADKSSTTAYMQLSSLTSEDSAVYYCAREVRLRYFDVWGAGTTVTVSS

SEQ ID NO: 316 - protein, 246 aa, Artificial Sequence
  source: /note="Description of Artificial Sequence: Synthetic polypeptide"
EIVLTQSPGSLAVSPGERVTMSCKSSQSVFFSSSQKNYLAWYQQIPGQSPRLLIYWASTRESGVPDRFTGSGSGTDFTLTISSVQPEDLAIYYCHQYLSSRTFGQGTKLEIKRGGGGSGGGGSSGGGSQVQLQQPGAEVVKPGASVKMSCKASGYTFTSYYIHWIKQTPGQGLEWVGVIYPGNDDISYNQKFQGKATLTADKSSTTAYMQLSSLTSEDSAVYYCAREVRLRYFDVWGQGTTVTVSS

SEQ ID NO: 317 - protein, 244 aa, Artificial Sequence
  source: /note="Description of Artificial Sequence: Synthetic polypeptide"
EVQLQQSGPELVKPGASMKISCKASGYSFTGYTMNWVKQSHGKNLEWIGLINPYNGGTIYNQKFKGKATLTVDKSSSTAYMELLSLTSEDSAVYYCARDYGFVLDYWGQGTTLTVSSGGGGSGGGGSGGGGSGGGGSQIVLTQSPSIMSVSPGEKVTITCSASSSVSYMHWFQQKPGTSPKLCIYSTSNLASGVPARFSGRGSGTSYSLTISRVAAEDAATYYCQQRSNYPPWTFGGGTKLEIK

SEQ ID NO: 318 - protein, 244 aa, Artificial Sequence
  source: /note="Description of Artificial Sequence: Synthetic polypeptide"
EVQLQQSGPELVKPGASMKISCKASGYSFTGYTMNWVKQSHGKNLEWIGLINPYNGGTIYNQKFKGKATLTVDKSSSTAYMELLSLTSEDSAVYYCARDYGFVLDYWGQGTTLTVSSGGGGSGGGGSGGGGSGGGGSQIVLTQSPAIMSASPGEKVTITCSASSSVSYLHWFQQKPGTSPKLWVYSTSNLPSGVPARFGGSGSGTSYSLTISRMEAEDAATYYCQQRSIYPPWTFGGGTKLEIK

SEQ ID NO: 319 - protein, 244 aa, Artificial Sequence
  source: /note="Description of Artificial Sequence: Synthetic polypeptide"
EVQLQQSGPELVKPGASMKISCKASGYSFTGYTMNWVKQSHGKNLEWIGLINPYNGGTIYNQKFKGKATLTVDKSSSTAYMELLSLTSEDSAVYYCARDYGFVLDYWGQGTTLTVSSGGGGSGGGGSGGGGSGGGGSQIVLTQSPSIMSVSPGEKVTITCSASSSVSYMHWFQQKPGTSPKLGIYSTSNLASGVPARFSGRGSGTSYSLTISRVAAEDAATYYCQQRSNYPPWTFGGGTKLEIK

SEQ ID NO: 320 - protein, 180 aa, Artificial Sequence
  source: /note="Description of Artificial Sequence: Synthetic polypeptide"
QAVVTQPPSASGTPGQRVTISCSGSSSNIGSNTVNWYQQVPGTAPKLLIYSNNQRPSGVPDRFSGSKSGTSASLAISGLQSEDEADYYCAAWDDSLNGWVFGGGTKLTVLGSRGGGGSGGGGSGGGGSLEMAQMQLVQSGAEVKEPGESLRISCKGSGYSFTNFWISWVRQMPGKGLEWM

SEQ ID NO: 321 - protein, 250 aa, Artificial Sequence
  source: /note="Description of Artificial Sequence: Synthetic polypeptide"
QTVVTQPPSASGTPGQRVTISCSGSSSNIGSNYVYWYQQLPGTAPKLLIYRSNQRPSGVPDRFSGSKSGTSASLAISGPRSVDEADYYCAAWDDSLNGVVFGGGTKLTVLGSRGGGGSGGGGSGGGSLEMAQVQLVQSGAEVKKPGSSVKVSCKASGGTFSSYAISWVRQAPGQGLEWMGGIIPIFGTANYAQKFQGRVTITADESTSTAYMELSSLRSEDTAVYYCARRIPPYYGMDVWGQGTTVTVSS

SEQ ID NO: 322 - protein, 250 aa, Artificial Sequence
  source: /note="Description of Artificial Sequence: Synthetic polypeptide"
DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVDIKRSRGGGGSGGGGSGGGGSLEMAQVQLQQSGPGLVKPSQTLSLTCAISGDSVSSNSAAWNWIRQSPSRGLEWLGRTYYGSKWYNDYAVSVKSRITINPDTSKNQFSLQLNSVTPEDTAVYYCARGRLGDAFDIWGQGTMVTVSS

SEQ ID NO: 323 - protein, 246 aa, Artificial Sequence
  source: /note="Description of Artificial Sequence: Synthetic polypeptide"
DIQMTQSPSTLSASVGDRVTITCRASQNINKWLAWYQQRPGKAPQLLIYKASSLESGVPSRFSGSGSGTEYTLTISSLQPDDFATYYCQQYNSYATFGQGTKVEIKRSRGGGGSGGGGSGGGGSLEMAQVQLVQSGAEVKKPGESLKISCKGSGYNFSNKWIGWVRQLPGRGLEWIAIIYPGYSDITYSPSFQGRVTISADTSINTAYLHWHSLKASDTAMYYCVRHTALAGFDYWGLGTLVTVSS

SEQ ID NO: 324 - protein, 249 aa, Artificial Sequence
  source: /note="Description of Artificial Sequence: Synthetic polypeptide"
QSVVTQPPSVSVAPGKTARITCGRNNIGSKSVHWYQQKPGQAPVLVVYDDSDRPSGIPERFSGSNSGNTATLTISRVEAGDEADYYCQVWDSSSDHVVFGGGTKLTVLGSRGGGGSGGGGSGGSLEMAEVQLVQSGGGVVRPGGSLRLSCAASGFTFDDYGMSWVRQAPGKGLEWVSGINWNGGSTGYADSVRGRFTISRDNAKNSLYLQMNSLRAEDTALYYCARERGYGYHDPHDYWGQGTLVTVSS

SEQ ID NO: 325 - protein, 251 aa, Artificial Sequence
  source: /note="Description of Artificial Sequence: Synthetic polypeptide"
QSVLTQPPSVSGAPGQRVTISCTGSSSNIGAGYDVHWYQQLPGTAPKLLIYGNSNRPSGVPDRFSGSKSGTSASLAISGLQSEDEADYYCAAWDDSLNGYVFGTGTKLTVLGSRGGGGSGGGGSGGGGSLEMAEVQLVETGGGLLQPGGSLRLSCAASGFSVSGTYMGWVRQAPGKGLEWVALLYSGGGTYHPASLQGRFIVSRDSSKNMVYLQMNSLKAEDTAVYYCAKGGAGGGHFDSWGQGTLVTVSS

SEQ ID NO: 326 - protein, 241 aa, Artificial Sequence
  source: /note="Description of Artificial Sequence: Synthetic polypeptide"
EVQLLESGGGLVQPGGSLRLSCAASGFTFSSYAMSWVRQAPGKGLEWVSQIDPWGQETLYADSVKGRFTISRDNSKNTLYLQMNSLRAEDTAVYYCAKLTGRFDYWGQGTLVTVSSGGGGSGGGGSGGGGSTDIQMTQSPSSLSASVGDRVTITCRASQSISSYLNWYQQKPGKAPKLLIYSASQLQSGVPSRFSGSGSGTDFTLTISSLQPEDFATYYCQQGPGTPNTFGQGTKVEIKRA

SEQ ID NO: 327 - DNA, 9810 bp, Artificial Sequence
  source: /note="Description of Artificial Sequence: Synthetic polynucleotide"
gtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctgcaagcttaatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacaataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacctgaaagcgaaagggaaaccagagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcctcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagattggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgattagactgtagcccaggaatatggcagctagattgtacacatttagaaggaaaagttatcttggtagcagttcatgtagccagtggatatatagaagcagaagtaattccagcagagacagggcaagaaacagcatacttcctcttaaaattagcaggaagatggccagtaaaaacagtacatacagacaatggcagcaatttcaccagtactacagttaaggccgcctgttggtgggcggggatcaagcaggaatttggcattccctacaatccccaaagtcaaggagtaatagaatctatgaataaagaattaaagaaaattataggacaggtaagagatcaggctgaacatcttaagacagcagtacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggctgcatacgcgtcgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgtgcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgagctagaatggggggacttgaaccctgcagcaggctcctgctcctgcctctcctgctggctgtaagtggtctccgtcctgtccaggcccaggcccagagcgattgcagttgctctacggtgagcccgggcgtgctggcagggatcgtgatgggagacctggtgctgacagtgctcattgccctggccgtgtacttcctgggccggctggtccctcgggggcgaggggctgcggaggcagcgacccggaaacagcgtatcactgagaccgagtcgccttatcaggagctccagggtcagaggtcggatgtctacagcgacctcaacacacagaggccgtattacaaagtcgagggcggcggagagggcagaggaagtcttctaacatgcggtgacgtggaggagaatcccggccctaggatggccttaccagtgaccgccttgctcctgccgctggccttgctgctccacgccgccaggccgggatcccaggtacaactgcagcagtctgggcctgagctggagaagcctggcgcttcagtgaagatatcctgcaaggcttctggttactcattcactggctacaccatgaactgggtgaagcagagccatggaaagagccttgagtggattggacttattactccttacaatggtgcttctagctacaaccagaagttcaggggcaaggccacattaactgtagacaagtcatccagcacagcctacatggacctcctcagtctgacatctgaagactctgcagtctatttctgtgcaagggggggttacgacgggaggggttttgactactggggccaagggaccacggtcaccgtctcctcaggtggaggcggttcaggcggcggtggctctagcggtggtggatcggacatcgagctcactcagtctccagcaatcatgtctgcatctccaggggagaaggtcaccatgacctgcagtgccagctcaagtgtaagttacatgcactggtaccagcagaagtcaggcacctcccccaaaagatggatttatgacacatccaaactggcttctggagtcccaggtcgcttcagtggcagtgggtctggaaactcttactctctcacaatcagcagcgtggaggctgaagatgatgcaacttattactgccagcagtggagtaagcaccctctcacgtacggtgctgggacaaagttggaaatcaaagctagcacgcgtggtggcggaggttctggaggtgggggttcccagggggcctggccacatgagggagtccacagaaaaccttccctcctggcccacccaggtcccctggtgaaatcagaagagacagtcatcctgcaatgttggtcagatgtcaggtttgagcacttccttctgcacagagaggggaagtataaggacactttgcacctcattggagagcaccatgatggggtctccaaggccaacttctccatcggtcccatgatgcaagaccttgcagggacctacagatgctacggttctgttactcactccccctatcagttgtcagctcccagtgaccctctggacatcgtcatcacaggtctatatgagaaaccttctctctcagcccagccgggccccacggttttggcaggagagagcgtgaccttgtcctgcagctcccggagctcctatgacatgtaccatctatccagggagggggaggcccatgaacgtaggttctctgcagggcccaaggtcaacggaacattccaggccgactttcctctgggccctgccacccacggaggaacctacagatgcttcggctctttccgtgactctccctatgagtggtcaaactcgagtgacccactgcttgtttctgtcacaggaaacccttcaaatagttggccttcacccactgaaccaagctccaaaaccggtaaccccagacacctgcatgttctgattgggacctcagtggtcaaaatccctttcaccatcctcctcttctttctccttcatcgctggtgctccaacaaaaaaaatgctgctgtaatggaccaagagcctgcagggaacagaacagtgaacagcgaggattctgatgaacaagaccatcaggaggtgtcatacgcataagtcgacaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcctggaattcgagctcggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggaacttgtttattgcagcttataatggttacaaataaagcaatagcatcacaaatttcacaaataaagcatttttttcactgcattctagttgtggtttgtccaaactcatcaatgtatcttatcatgtctggctctagctatcccgcccctaactccgcccagttccgcccattctccgccccatggctgactaattttttttatttatgcagaggccgaggccgcctcggcctctgagctattccagaagtagtgaggaggcttttttggaggcctacgcttttgcgtcgagacgtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcccaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgg

SEQ ID NO: 328 - DNA, 9165 bp, Artificial Sequence
  source: /note="Description of Artificial Sequence: Synthetic polynucleotide"
gtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctgcaagcttaatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacaataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacctgaaagcgaaagggaaaccagagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcctcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagattggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgattagactgtagcccaggaatatggcagctagattgtacacatttagaaggaaaagttatcttggtagcagttcatgtagccagtggatatatagaagcagaagtaattccagcagagacagggcaagaaacagcatacttcctcttaaaattagcaggaagatggccagtaaaaacagtacatacagacaatggcagcaatttcaccagtactacagttaaggccgcctgttggtgggcggggatcaagcaggaatttggcattccctacaatccccaaagtcaaggagtaatagaatctatgaataaagaattaaagaaaattataggacaggtaagagatcaggctgaacatcttaagacagcagtacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggctgcatacgcgtcgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgtgcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgagctagaatggggggacttgaaccctgcagcaggctcctgctcctgcctctcctgctggctgtaagtggtctccgtcctgtccaggcccaggcccagagcgattgcagttgctctacggtgagcccgggcgtgctggcagggatcgtgatgggagacctggtgctgacagtgctcattgccctggccgtgtacttcctgggccggctggtccctcgggggcgaggggctgcggaggcagcgacccggaaacagcgtatcactgagaccgagtcgccttatcaggagctccagggtcagaggtcggatgtctacagcgacctcaacacacagaggccgtattacaaagtcgagggcggcggagagggcagaggaagtcttctaacatgcggtgacgtggaggagaatcccggccctaggatggccttaccagtgaccgccttgctcctgccgctggccttgctgctccacgccgccaggccgggatcccaggtacaactgcagcagtctgggcctgagctggagaagcctggcgcttcagtgaagatatcctgcaaggcttctggttactcattcactggctacaccatgaactgggtgaagcagagccatggaaagagccttgagtggattggacttattactccttacaatggtgcttctagctacaaccagaagttcaggggcaaggccacattaactgtagacaagtcatccagcacagcctacatggacctcctcagtctgacatctgaagactctgcagtctatttctgtgcaagggggggttacgacgggaggggttttgactactggggccaagggaccacggtcaccgtctcctcaggtggaggcggttcaggcggcggtggctctagcggtggtggatcggacatcgagctcactcagtctccagcaatcatgtctgcatctccaggggagaaggtcaccatgacctgcagtgccagctcaagtgtaagttacatgcactggtaccagcagaagtcaggcacctcccccaaaagatggatttatgacacatccaaactggcttctggagtcccaggtcgcttcagtggcagtgggtctggaaactcttactctctcacaatcagcagcgtggaggctgaagatgatgcaacttattactgccagcagtggagtaagcaccctctcacgtacggtgctgggacaaagttggaaatcaaagctagcggtggcggaggttctggaggtgggggttcctcacccactgaaccaagctccaaaaccggtaaccccagacacctgcatgttctgattgggacctcagtggtcaaaatccctttcaccatcctcctcttctttctccttcatcgctggtgctccaacaaaaaaaatgctgctgtaatggaccaagagcctgcagggaacagaacagtgaacagcgaggattctgatgaacaagaccatcaggaggtgtcatacgcataagtcgacaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcctggaattcgagctcggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggaacttgtttattgcagcttataatggttacaaataaagcaatagcatcacaaatttcacaaataaagcatttttttcactgcattctagttgtggtttgtccaaactcatcaatgtatcttatcatgtctggctctagctatcccgcccctaactccgcccagttccgcccattctccgccccatggctgactaattttttttatttatgcagaggccgaggccgcctcggcctctgagctattccagaagtagtgaggaggcttttttggaggcctacgcttttgcgtcgagacgtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcccaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgg

SEQ ID NO: 329 - DNA, 9915 bp, Artificial Sequence
  source: /note="Description of Artificial Sequence: Synthetic polynucleotide"
gtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctgcaagcttaatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacaataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacctgaaagcgaaagggaaaccagagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcctcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagattggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgattagactgtagcccaggaatatggcagctagattgtacacatttagaaggaaaagttatcttggtagcagttcatgtagccagtggatatatagaagcagaagtaattccagcagagacagggcaagaaacagcatacttcctcttaaaattagcaggaagatggccagtaaaaacagtacatacagacaatggcagcaatttcaccagtactacagttaaggccgcctgttggtgggcggggatcaagcaggaatttggcattccctacaatccccaaagtcaaggagtaatagaatctatgaataaagaattaaagaaaattataggacaggtaagagatcaggctgaacatcttaagacagcagtacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggctgcatacgcgtcgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgtgcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgagctagaatggggggacttgaaccctgcagcaggctcctgctcctgcctctcctgctggctgtaagtggtctccgtcctgtccaggcccaggcccagagcgattgcagttgctctacggtgagcccgggcgtgctggcagggatcgtgatgggagacctggtgctgacagtgctcattgccctggccgtgtacttcctgggccggctggtccctcgggggcgaggggctgcggaggcagcgacccggaaacagcgtatcactgagaccgagtcgccttatcaggagctccagggtcagaggtcggatgtctacagcgacctcaacacacagaggccgtattacaaagtcgagggcggcggagagggcagaggaagtcttctaacatgcggtgacgtggaggagaatcccggccctaggatggccttaccagtgaccgccttgctcctgccgctggccttgctgctccacgccgccaggccgggatcccaggtacaactgcagcagtctgggcctgagctggagaagcctggcgcttcagtgaagatatcctgcaaggcttctggttactcattcactggctacaccatgaactgggtgaagcagagccatggaaagagccttgagtggattggacttattactccttacaatggtgcttctagctacaaccagaagttcaggggcaaggccacattaactgtagacaagtcatccagcacagcctacatggacctcctcagtctgacatctgaagactctgcagtctatttctgtgcaagggggggttacgacgggaggggttttgactactggggccaagggaccacggtcaccgtctcctcaggtggaggcggttcaggcggcggtggctctagcggtggtggatcggacatcgagctcactcagtctccagcaatcatgtctgcatctccaggggagaaggtcaccatgacctgcagtgccagctcaagtgtaagttacatgcactggtaccagcagaagtcaggcacctcccccaaaagatggatttatgacacatccaaactggcttctggagtcccaggtcgcttcagtggcagtgggtctggaaactcttactctctcacaatcagcagcgtggaggctgaagatgatgcaacttattactgccagcagtggagtaagcaccctctcacgtacggtgctgggacaaagttggaaatcaaagctagcggtggcggaggttctggaggtgggggttcccagggggcctggccacatgagggagtccacagaaaaccttccctcctggcccacccaggtcccctggtgaaatcagaagagacagtcatcctgcaatgttggtcagatgtcaggtttcagcacttccttctgcacagagaagggaagtttaaggacactttgcacctcattggagagcaccatgatggggtctccaaggccaacttctccatcggtcccatgatgcaagaccttgcagggacctacagatgctacggttctgttactcactccccctatcagttgtcagctcccagtgaccctctggacatcgtcatcacaggtctatatgagaaaccttctctctcagcccagccgggccccacggttctggcaggagagagcgtgaccttgtcctgcagctcccggagctcctatgacatgtaccatctatccagggagggggaggcccatgaacgtaggttctctgcagggcccaaggtcaacggaacattccaggccgactttcctctgggccctgccacccacggaggaacctacagatgcttcggctctttccgtgactctccatacgagtggtcaaactcgagtgacccactgcttgtttctgtcacaggaaacccttcaaatagttggctttcacccactgaaccaagctccgaaaccggtaaccccagacacctgcatgttctgattgggacctcagtggtcatcatcctcttcatcctcctcctcttctttctccttcatcgctggtgctgcaacaaaaaaaatgctgttgtaatggaccaagagcctgcagggaacagaacagtgaacagggaggactctgatgaacaagaccctcaggaggtgacatatgcacagttgaatcactgcgttttcacacagagaaaaatcactcacccttctcagaggcccaagacacccccaacagatatcatcgtgtacacggaacttccaaatgctgagccctgagtcgacaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcctggaattcgagctcggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggaacttgtttattgcagcttataatggttacaaataaagcaatagcatcacaaatttcacaaataaagcatttttttcactgcattctagttgtggtttgtccaaactcatcaatgtatcttatcatgtctggctctagctatcccgcccctaactccgcccagttccgcccattctccgccccatggctgactaattttttttatttatgcagaggccgaggccgcctcggcctctgagctattccagaagtagtgaggaggcttttttggaggcctacgcttttgcgtcgagacgtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcccaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgg

SEQ ID NO: 330 - DNA, 9816 bp, Artificial Sequence
  source: /note="Description of Artificial Sequence: Synthetic polynucleotide"
gtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctgcaagcttaatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacaataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacctgaaagcgaaagggaaaccagagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcctcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagattggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgattagactgtagcccaggaatatggcagctagattgtacacatttagaaggaaaagttatcttggtagcagttcatgtagccagtggatatatagaagcagaagtaattccagcagagacagggcaagaaacagcatacttcctcttaaaattagcaggaagatggccagtaaaaacagtacatacagacaatggcagcaatttcaccagtactacagttaaggccgcctgttggtgggcggggatcaagcaggaatttggcattccctacaatccccaaagtcaaggagtaatagaatctatgaataaagaattaaagaaaattataggacaggtaagagatcaggctgaacatcttaagacagcagtacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttggctgcatacgcgtcgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgtgcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgagctagaatggggggacttgaaccctgcagcaggctcctgctcctgcctctcctgctggctgtaagtggtctccgtcctgtccaggcccaggcccagagcgattgcagttgctctacggtgagcccgggcgtgctggcagggatcgtgatgggagacctggtgctgacagtgctcattgccctggccgtgtacttcctgggccggctggtccctcgggggcgaggggctgcggaggcagcgacccggaaacagcgtatcactgagaccgagtcgccttatcaggagctccagggtcagaggtcggatgtctacagcgacctcaacacacagaggccgtattacaaagtcgagggcggcggagagggcagaggaagtcttctaacatgcggtgacgtggaggagaatcccggccctaggatggccttaccagtgaccgccttgctcctgccgctggccttgctgctccacgccgccaggccgggatccgacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggactaagttggaaataacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggtcaaggaacctcagtcaccgtctcctcagctagcacgcgtggtggcggaggttctggaggtgggggttcccagggggcctggccacatgagggagtccacagaaaaccttccctcctggcccacccaggtcccctggtgaaatcagaagagacagtcatcctgcaatgttggtcagatgtcaggtttgagcacttccttctgcacagagaggggaagtataaggacactttgcacctcattggagagcaccatgatggggtctccaaggccaacttctccatcggtcccatgatgcaagaccttgcagggacctacagatgctacggttctgttactcactccccctatcagttgtcagctcccagtgaccctctggacatcgtcatcacaggtctatatgagaaaccttctctctcagcccagccgggccccacggttttggcaggagagagcgtgaccttgtcctgcagctcccggagctcctatgacatgtaccatctatccagggagggggaggcccatgaacgtaggttctctgcagggcccaaggtcaacggaacattccaggccgactttcctctgggccctgccacccacggaggaacctacagatgcttcggctctttccgtgactctccctatgagtggtcaaactcgagtgacccactgcttgtttctgtcacaggaaacccttcaaatagttggccttcacccactgaaccaagctccaaaaccggtaaccccagacacctgcatgttctgattgggacctcagtggtcaaaatccctttcaccatcctcctcttctttctccttcatcgctggtgctccaacaaaaaaaatgctgctgtaatggaccaagagcctgcagggaacagaacagtgaacagcgaggattctgatgaacaagaccatcaggaggtgtcatacgcataagtcgacaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcctggaattcgagctcggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggaacttgtttattgcagcttataatggttacaaataaagcaatagcatcacaaatttcacaaataaagcatttttttcactgcattctagttgtggtttgtccaaactcatcaatgtatcttatcatgtctggctctagctatcccgcccctaactccgcccagttccgcccattctccgccccatggctgactaattttttttatttatgcagaggccgaggccgcctcggcctctgagctattccagaagtagtgaggaggcttttttggaggcctacgcttttgcgtcgagacgtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcccaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgg

SEQ ID NO: 331 - DNA, 3821 bp, Artificial Sequence
  source: /note="Description of Artificial Sequence: Synthetic polynucleotide"
tgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctctaatacgactcactatagggagacaagcttgcatgcctgcaggtcgacatggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggactaagttggaaataacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggtcaaggaacctcagtcaccgtctcctcagctagcacgcgtggtggcggaggttctggaggtgggggttccaccctggtggttggtgtcgtgggcggcctgctgggcagcctggtgctgctagtctgggtcctggccgtcatctgctcccgggccgcacgagggacaataggagccaggcgcaccggccagcccctgaaggaggacccctcagccgtgcctgtgttctctgtggactatggggagctggatttccagtggcgagagaagaccccggagccccccgtgccctgtgtccctgagcagacggagtatgccaccattgtctttcctagcggaatgggcacctcatcccccgcccgcaggggctcagctgacggccctcggagtgcccagccactgaggcctgaggatggacactgctcttggcccctctgaggatccccgggtaccgagctcgaattcaaaaaaaaaaaaaaaaaaaaaaaaaaaaaaaaaaaaaaaaaaaaaaaaaaaaaaaaaaaaaaaactagtggcgcc

SEQ ID NO: 332 - DNA, 1464 bp, Artificial Sequence
  source: /note="Description of Artificial Sequence: Synthetic polynucleotide"
atggggggacttgaaccctgcagcaggttcctgctcctgcctctcctgctggctgtaagtggtctccgtcctgtccaggtccaggcccagagcgattgcagttgctctacggtgagcccgggcgtgctggcagggatcgtgatgggagacctggtgctgacagtgctcattgccctggccgtgtacttcctgggccggctggtccctcgggggcgaggggctgcggaggcagcgacccggaaacagcgtatcactgagaccgagtcgccttatcaggagctccagggtcagaggtcggatgtctacagcgacctcaacacacagaggccgtattacaaagtcgagggcggcggagagggcagaggaagtcttctaacatgcggtgacgtggaggagaatcccggccctaggatggccttaccagtgaccgccttgctcctgccgctggccttgctgctccacgccgccaggccgggatcccaggtacaactgcagcagtctgggcctgagctggagaagcctggcgcttcagtgaagatatcctgcaaggcttctggttactcattcactggctacaccatgaactgggtgaagcagagccatggaaagagccttgagtggattggacttattactccttacaatggtgcttctagctacaaccagaagttcaggggcaaggccacattaactgtagacaagtcatccagcacagcctacatggacctcctcagtctgacatctgaagactctgcagtctatttctgtgcaagggggggttacgacgggaggggttttgactactggggccaagggaccacggtcaccgtctcctcaggtggaggcggttcaggcggcggtggctctagcggtggtggatcggacatcgagctcactcagtctccagcaatcatgtctgcatctccaggggagaaggtcaccatgacctgcagtgccagctcaagtgtaagttacatgcactggtaccagcagaagtcaggcacctcccccaaaagatggatttatgacacatccaaactggcttctggagtcccaggtcgcttcagtggcagtgggtctggaaactcttactctctcacaatcagcagcgtggaggctgaagatgatgcaacttattactgccagcagtggagtaagcaccctctcacgtacggtgctgggacaaagttggaaatcaaagctagcggtggcggaggttctggaggtgggggttcctcacccactgaaccaagctccaaaaccggtaaccccagacacctgcatgttctgattgggacctcagtggtcaaaatccctttcaccatcctcctcttctttctccttcatcgctggtgctccaacaaaaaaaatgctgctgtaatggaccaagagcctgcagggaacagaacagtgaacagcgaggattctgatgaacaagaccatcaggaggtgtcatacgcataa

SEQ ID NO: 333 - protein, 487 aa, Artificial Sequence
  source: /note="Description of Artificial Sequence: Synthetic polypeptide"
MGGLEPCSRFLLLPLLLAVSGLRPVQVQAQSDCSCSTVSPGVLAGIVMGDLVLTVLIALAVYFLGRLVPRGRGAAEAATRKQRITETESPYQELQGQRSDVYSDLNTQRPYYKVEGGGEGRGSLLTCGDVEENPGPRMALPVTALLLPLALLLHAARPGSQVQLQQSGPELEKPGASVKISCKASGYSFTGYTMNWVKQSHGKSLEWIGLITPYNGASSYNQKFRGKATLTVDKSSSTAYMDLLSLTSEDSAVYFCARGGYDGRGFDYWGQGTTVTVSSGGGGSGGGGSSGGGSDIELTQSPAIMSASPGEKVTMTCSASSSVSYMHWYQQKSGTSPKRWIYDTSKLASGVPGRFSGSGSGNSYSLTISSVEAEDDATYYCQQWSKHPLTYGAGTKLEIKASGGGGSGGGGSSPTEPSSKTGNPRHLHVLIGTSVVKIPFTILLFFLLHRWCSNKKNAAVMDQEPAGNRTVNSEDSDEQDHQEVSYA

SEQ ID NO: 334 - DNA, 1365 bp, Artificial Sequence
  source: /note="Description of Artificial Sequence: Synthetic polynucleotide"
atgattccagcagtggtcttgctcttactccttttggttgaacaagcagcggccctgggagagcctcagctctgctatatcctggatgccatcctgtttctgtatggaattgtcctcaccctcctctactgccgactgaagatccaagtgcgaaaggcagctataaccagctatgagaaatcagatggtgtttacacgggcctgagcaccaggaaccaggagacttacgagactctgaagcatgagaaaccaccacagtccggaggcggcggagagggcagaggaagtcttctaacatgcggtgacgtggaggagaatcccggccctaggatggccttaccagtgaccgccttgctcctgccgctggccttgctgctccacgccgccaggccgggatcccaggtacaactgcagcagtctgggcctgagctggagaagcctggcgcttcagtgaagatatcctgcaaggcttctggttactcattcactggctacaccatgaactgggtgaagcagagccatggaaagagccttgagtggattggacttattactccttacaatggtgcttctagctacaaccagaagttcaggggcaaggccacattaactgtagacaagtcatccagcacagcctacatggacctcctcagtctgacatctgaagactctgcagtctatttctgtgcaagggggggttacgacgggaggggttttgactactggggccaagggaccacggtcaccgtctcctcaggtggaggcggttcaggcggcggtggctctagcggtggtggatcggacatcgagctcactcagtctccagcaatcatgtctgcatctccaggggagaaggtcaccatgacctgcagtgccagctcaagtgtaagttacatgcactggtaccagcagaagtcaggcacctcccccaaaagatggatttatgacacatccaaactggcttctggagtcccaggtcgcttcagtggcagtgggtctggaaactcttactctctcacaatcagcagcgtggaggctgaagatgatgcaacttattactgccagcagtggagtaagcaccctctcacgtacggtgctgggacaaagttggaaatcaaagctagcggtggcggaggttctggaggtgggggttccttaaccacagagacgggactccagaaagaccatgccctctgggatcacactgcccagaatctccttcggatgggcctggcctttctagtcctggtggctctagtgtggttcctggttgaagactggctcagcaggaagaggactagagagcgagccagcagagcttccacttgggaaggcaggagaaggctgaacacacagactctttga

SEQ ID NO: 335 - protein, 454 aa, Artificial Sequence
  source: /note="Description of Artificial Sequence: Synthetic polypeptide"
MIPAVVLLLLLLVEQAAALGEPQLCYILDAILFLYGIVLTLLYCRLKIQVRKAAITSYEKSDGVYTGLSTRNQETYETLKHEKPPQSGGGGEGRGSLLTCGDVEENPGPRMALPVTALLLPLALLLHAARPGSQVQLQQSGPELEKPGASVKISCKASGYSFTGYTMNWVKQSHGKSLEWIGLITPYNGASSYNQKFRGKATLTVDKSSSTAYMDLLSLTSEDSAVYFCARGGYDGRGFDYWGQGTTVTVSSGGGGSGGGGSSGGGSDIELTQSPAIMSASPGEKVTMTCSASSSVSYMHWYQQKSGTSPKRWIYDTSKLASGVPGRFSGSGSGNSYSLTISSVEAEDDATYYCQQWSKHPLTYGAGTKLEIKASGGGGSGGGGSLTTETGLQKDHALWDHTAQNLLRMGLAFLVLVALVWFLVEDWLSRKRTRERASRASTWEGRRRLNTQTL

SEQ ID NO: 336 - DNA, 1470 bp, Artificial Sequence
  source: /note="Description of Artificial Sequence: Synthetic polynucleotide"
atggggggacttgaaccctgcagcaggttcctgctcctgcctctcctgctggctgtaagtggtctccgtcctgtccaggtccaggcccagagcgattgcagttgctctacggtgagcccgggcgtgctggcagggatcgtgatgggagacctggtgctgacagtgctcattgccctggccgtgtacttcctgggccggctggtccctcgggggcgaggggctgcggaggcagcgacccggaaacagcgtatcactgagaccgagtcgccttatcaggagctccagggtcagaggtcggatgtctacagcgacctcaacacacagaggccgtattacaaagtcgagggcggcggagagggcagaggaagtcttctaacatgcggtgacgtggaggagaatcccggccctaggatggccttaccagtgaccgccttgctcctgccgctggccttgctgctccacgccgccaggccgggatccgacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggactaagttggaaataacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggtcaaggaacctcagtcaccgtctcctcagctagcggtggcggaggttctggaggtgggggttcctcacccactgaaccaagctccaaaaccggtaaccccagacacctgcatgttctgattgggacctcagtggtcaaaatccctttcaccatcctcctcttctttctccttcatcgctggtgctccaacaaaaaaaatgctgctgtaatggaccaagagcctgcagggaacagaacagtgaacagcgaggattctgatgaacaagaccatcaggaggtgtcatacgcataa

SEQ ID NO: 337 - protein, 489 aa, Artificial Sequence
  source: /note="Description of Artificial Sequence: Synthetic polypeptide"
MGGLEPCSRFLLLPLLLAVSGLRPVQVQAQSDCSCSTVSPGVLAGIVMGDLVLTVLIALAVYFLGRLVPRGRGAAEAATRKQRITETESPYQELQGQRSDVYSDLNTQRPYYKVEGGGEGRGSLLTCGDVEENPGPRMALPVTALLLPLALLLHAARPGSDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSASGGGGSGGGGSSPTEPSSKTGNPRHLHVLIGTSVVKIPFTILLFFLLHRWCSNKKNAAVMDQEPAGNRTVNSEDSDEQDHQEVSYA

SEQ ID NO: 338 - protein, 97 aa, Artificial Sequence
  source: /note="Description of Artificial Sequence: Synthetic polypeptide"
CSRAARGTIGARRTGQPLKEDPSAVPVFSVDYGELDFQWREKTPEPPVPCVPEQTEYATIVFPSGMGTSSPARRGSADGPRSAQPLRPEDGHCSWPL

SEQ ID NO: 339 - protein, 41 aa, Artificial Sequence
  source: /note="Description of Artificial Sequence: Synthetic polypeptide"
AVSLSKMLKKRSPLTTGVYVKMPPTEPECEKQFQPYFIPIN

SEQ ID NO: 340 - protein, 43 aa, Homo sapiens
TTTPAPRPPTPAPTIASQPLSLRPEACRPAAGGAVHTRGLDFA

SEQ ID NO: 341 - protein, 16 aa, Unknown
  source: /note="Description of Unknown: ITAM motif peptide"
  MOD_RES (2)..(3): Any amino acid
  MOD_RES (5)..(12): Any amino acid
  VARIANT (11)..(12): /replace=" "
  MISC_FEATURE (5)..(12): /note="This region may encompass 6-8 residues"
  MOD_RES (14)..(15): Any amino acid
  MISC_FEATURE (1)..(16): /note="Variant residues given in the sequence have no preference with respect to those in the annotations for variant positions"
YXXLXXXXXXXXYXXL

SEQ ID NO: 342 - DNA, 1578 bp, Artificial Sequence
  source: /note="Description of Artificial Sequence: Synthetic polynucleotide"
  CDS (36)..(947)
ctggggcgcggccgcctgtctgcacagacagcaccatgtcgctcatggtcgtcagcatggcgtgtgttgggttcttcttgctgcagggggcctggccacatgagggagtccacagaaaaccttccctcctggcccacccaggtcccctggtgaaatcagaagagacagtcatcctgcaatgttggtcagatgtcaggtttgagcacttccttctgcacagagaggggaagtataaggacactttgcacctcattggagagcaccatgatggggtctccaaggccaacttctccatcggtcccatgatgcaagaccttgcagggacctacagatgctacggttctgttactcactccccctatcagttgtcagctcccagtgaccctctggacatcgtcatcacaggtctatatgagaaaccttctctctcagcccagccgggccccacggttttggcaggagagagcgtgaccttgtcctgcagctcccggagctcctatgacatgtaccatctatccagggagggggaggcccatgaacgtaggttctctgcagggcccaaggtcaacggaacattccaggccgactttcctctgggccctgccacccacggaggaacctacagatgcttcggctctttccgtgactctccctatgagtggtcaaactcgagtgacccactgcttgtttctgtcacaggaaacccttcaaatagttggccttcacccactgaaccaagctccaaaaccggtaaccccagacacctgcatgttctgattgggacctcagtggtcaaaatccctttcaccatcctcctcttctttctccttcatcgctggtgctccaacaaaaaaaatgctgctgtaatggaccaagagcctgcagggaacagaacagtgaacagcgaggattctgatgaacaagaccatcaggaggtgtcatacgcataattggatcactgtgttttcacacagagaaaaatcactcgcccttctgagaggcccaagacacccccaacagataccagcatgtacatagaacttccaaatgctgagcccagatccaaagttgtcttctgtccacgagcaccacagtcaggccttgaggggatcttctagggagacaacagccctgtctcaaaaccgggttgccagctcccatgtaccagcagctggaatctgaaggcatcagtcttcatcttagggcatcgctcttcctcacaccacgaatctgaacatgcctctctcttgcttacaaatgtctaaggtccccactgcctgctggagagaaaacacactcctttgcttagcccacaattctccatttcacttgacccctgcccacctctccaacctaactggcttacttcctagtctacctgaggctgcaatcacactgaggaactcacaattccaaacatacaagaggctgcctcttaacacagcacttagacacgtgctgttccacctcccttcagactatctttcagccttctgccagcagtaaaacttataaattttttaaataatttcaatgtagttttcccgccttcaaataaacatgtctgccctcatgaaa

SEQ ID NO: 343 - protein, 304 aa, Artificial Sequence
  source: /note="Description of Artificial Sequence: Synthetic polypeptide"
MSLMVVSMACVGFFLLQGAWPHEGVHRKPSLLAHPGPLVKSEETVILQCWSDVRFEHFLLHREGKYKDTLHLIGEHHDGVSKANFSIGPMMQDLAGTYRCYGSVTHSPYQLSAPSDPLDIVITGLYEKPSLSAQPGPTVLAGESVTLSCSSRSSYDMYHLSREGEAHERRFSAGPKVNGTFQADFPLGPATHGGTYRCFGSFRDSPYEWSNSSDPLLVSVTGNPSNSWPSPTEPSSKTGNPRHLHVLIGTSVVKIPFTILLFFLLHRWCSNKKNAAVMDQEPAGNRTVNSEDSDEQDHQEVSYA

SEQ ID NO: 344 - DNA, 1596 bp, Artificial Sequence
  source: /note="Description of Artificial Sequence: Synthetic polynucleotide"
  CDS (38)..(1060)
agctggggcgcggccgcctgtctgcacagacagcaccatgtcgctcatggtcgtcagcatggtgtgtgttgggttcttcttgctgcagggggcctggccacatgagggagtccacagaaaaccttccctcctggcccacccaggtcccctggtgaaatcagaagagacagtcatcctgcaatgttggtcagatgtcaggtttcagcacttccttctgcacagagaagggaagtttaaggacactttgcacctcattggagagcaccatgatggggtctccaaggccaacttctccatcggtcccatgatgcaagaccttgcagggacctacagatgctacggttctgttactcactccccctatcagttgtcagctcccagtgaccctctggacatcgtcatcacaggtctatatgagaaaccttctctctcagcccagccgggccccacggttctggcaggagagagcgtgaccttgtcctgcagctcccggagctcctatgacatgtaccatctatccagggagggggaggcccatgaacgtaggttctctgcagggcccaaggtcaacggaacattccaggccgactttcctctgggccctgccacccacggaggaacctacagatgcttcggctctttccgtgactctccatacgagtggtcaaactcgagtgacccactgcttgtttctgtcacaggaaacccttcaaatagttggccttcacccactgaaccaagctccgaaaccggtaaccccagacacctgcatgttctgattgggacctcagtggtcatcatcctcttcatcctcctcctcttctttctccttcatcgctggtgctgcaacaaaaaaaatgctgttgtaatggaccaagagcctgcagggaacagaacagtgaacagggaggactctgatgaacaagaccctcaggaggtgacatatgcacagttgaatcactgcgttttcacacagagaaaaatcactcgcccttctcagaggcccaagacacccccaacagatatcatcgtgtacacggaacttccaaatgctgagccctgatccaaagttgtctcctgcccatgagcaccacagtcaggccttgaggggatcttctagggagacaacagccctgtctcaaaactgggttgccagctccaatgtaccagcagctggaatctgaaggcgtgagtctgcatcttagggcatcgctcttcctcacaccacaaatctgaacgtgcctctcccttgcttacaaatgtctaaggtccccactgcctgctggagagaaaacacactcctttgcttagcccacaattctccatttcacttgacccctgcccacctctccaacctaactggcttacttcctagtctacttgaggctgcaatcacactgaggaactcacaattccaaacatacaagaggctccctcttaacacggcacttagacacgtgctgttccaccttccctcatgctgttccacctcccctcagactagctttcagccttctgtcagcagtaaaacttatatattttttaaaataatttcaatgtagttttccctccttcaaataaacatgtctgccctca

SEQ ID NO: 345 - protein, 341 aa, Artificial Sequence
  source: /note="Description of Artificial Sequence: Synthetic polypeptide"
MSLMVVSMVCVGFFLLQGAWPHEGVHRKPSLLAHPGPLVKSEETVILQCWSDVRFQHFLLHREGKFKDTLHLIGEHHDGVSKANFSIGPMMQDLAGTYRCYGSVTHSPYQLSAPSDPLDIVITGLYEKPSLSAQPGPTVLAGESVTLSCSSRSSYDMYHLSREGEAHERRFSAGPKVNGTFQADFPLGPATHGGTYRCFGSFRDSPYEWSNSSDPLLVSVTGNPSNSWPSPTEPSSETGNPRHLHVLIGTSVVIILFILLLFFLLHRWCCNKKNAVVMDQEPAGNRTVNREDSDEQDPQEVTYAQLNHCVFTQRKITRPSQRPKTPPTDIIVYTELPNAEP

SEQ ID NO: 346 - DNA, 1153 bp, Artificial Sequence
  source: /note="Description of Artificial Sequence: Synthetic polynucleotide"
  CDS (39)..(950)
tccccactgctcagcactaggccggcagaatctgagcgatgtcttccacactccctgccctgctctgcgtcgggctgtgtctgagtcagaggatcagcgcccagcagcagactctcccaaaaccgttcatctgggccgagccccatttcatggttccaaaggaaaagcaagtgaccatctgttgccagggaaattatggggctgttgaataccagctgcactttgaaggaagcctttttgccgtggacagaccaaaaccccctgagcggattaacaaagtccaattctacatcccggacatgaactcccgcatggcagggcaatacagctgcatctatcgggttggggagctctggtcagagcccagcaacttgctggatctggtggtaacagaaatgtatgacacacccaccctctcggttcatcctggacccgaagtgatctcgggagagaaggtgaccttctactgccgtctagacactgcaacaagcatgttcttactgctcaaggagggaagatccagccacgtacagcgcggatacgggaaggtccaggcggagttccccctgggccctgtgaccacagcccacagagggacataccgatgttttggctcctataacaaccatgcctggtctttccccagtgagccagtgaagctcctggtcacaggcgacattgagaacaccagccttgcacctgaagaccccacctttcctgcagacacttggggcacctaccttttaaccacagagacgggactccagaaagaccatgccctctgggatcacactgcccagaatctccttcggatgggcctggcctttctagtcctggtggctctagtgtggttcctggttgaagactggctcagcaggaagaggactagagagcgagccagcagagcttccacttgggaaggcaggagaaggctgaacacacagactctttgaagaatgaccatgagacacagtggccatgggtggatctgaaagctggtgttgagcctgggcggcgtgagctctgtgttggacccacggaggagggagtcactgcagggaaagagggacactggcattccatttgtcagagcatcccggacgatgcagagggtgggagaactacatgctaaatttctttttttttttttttg

SEQ ID NO: 347 - protein, 304 aa, Artificial Sequence
  source: /note="Description of Artificial Sequence: Synthetic polypeptide"
MSSTLPALLCVGLCLSQRISAQQQTLPKPFIWAEPHFMVPKEKQVTICCQGNYGAVEYQLHFEGSLFAVDRPKPPERINKVQFYIPDMNSRMAGQYSCIYRVGELWSEPSNLLDLVVTEMYDTPTLSVHPGPEVISGEKVTFYCRLDTATSMFLLLKEGRSSHVQRGYGKVQAEFPLGPVTTAHRGTYRCFGSYNNHAWSFPSEPVKLLVTGDIENTSLAPEDPTFPADTWGTYLLTTETGLQKDHALWDHTAQNLLRMGLAFLVLVALVWFLVEDWLSRKRTRERASRASTWEGRRRLNTQTL

SEQ ID NO: 348 - DNA, 1053 bp, Artificial Sequence
  source: /note="Description of Artificial Sequence: Synthetic polynucleotide"
  CDS (1)..(1050)
atggccttaccagtgaccgccttgctcctgccgctggccttgctgctccacgccgccaggccgggatcccaggtacaactgcagcagtctgggcctgagctggagaagcctggcgcttcagtgaagatatcctgcaaggcttctggttactcattcactggctacaccatgaactgggtgaagcagagccatggaaagagccttgagtggattggacttattactccttacaatggtgcttctagctacaaccagaagttcaggggcaaggccacattaactgtagacaagtcatccagcacagcctacatggacctcctcagtctgacatctgaagactctgcagtctatttctgtgcaagggggggttacgacgggaggggttttgactactggggccaagggaccacggtcaccgtctcctcaggtggaggcggttcaggcggcggtggctctagcggtggtggatcggacatcgagctcactcagtctccagcaatcatgtctgcatctccaggggagaaggtcaccatgacctgcagtgccagctcaagtgtaagttacatgcactggtaccagcagaagtcaggcacctcccccaaaagatggatttatgacacatccaaactggcttctggagtcccaggtcgcttcagtggcagtgggtctggaaactcttactctctcacaatcagcagcgtggaggctgaagatgatgcaacttattactgccagcagtggagtaagcaccctctcacgtacggtgctgggacaaagttggaaatcaaagctagcggtggcggaggttctggaggtgggggttcctcacccactgaaccaagctccaaaaccggtaaccccagacacctgcatgttctgattgggacctcagtggtcaaaatccctttcaccatcctcctcttctttctccttcatcgctggtgctccaacaaaaaaaatgctgctgtaatggaccaagagcctgcagggaacagaacagtgaacagcgaggattctgatgaacaagaccatcaggaggtgtcatacgcataa

SEQ ID NO: 349 - protein, 350 aa, Artificial Sequence
  source: /note="Description of Artificial Sequence: Synthetic polypeptide"
MALPVTALLLPLALLLHAARPGSQVQLQQSGPELEKPGASVKISCKASGYSFTGYTMNWVKQSHGKSLEWIGLITPYNGASSYNQKFRGKATLTVDKSSSTAYMDLLSLTSEDSAVYFCARGGYDGRGFDYWGQGTTVTVSSGGGGSGGGGSSGGGSDIELTQSPAIMSASPGEKVTMTCSASSSVSYMHWYQQKSGTSPKRWIYDTSKLASGVPGRFSGSGSGNSYSLTISSVEAEDDATYYCQQWSKHPLTYGAGTKLEIKASGGGGSGGGGSSPTEPSSKTGNPRHLHVLIGTSVVKIPFTILLFFLLHRWCSNKKNAAVMDQEPAGNRTVNSEDSDEQDHQEVSYA

SEQ ID NO: 350 - DNA, 1698 bp, Artificial Sequence
  source: /note="Description of Artificial Sequence: Synthetic polynucleotide"
  CDS (1)..(1695)
atggccttaccagtgaccgccttgctcctgccgctggccttgctgctccacgccgccaggccgggatcccaggtacaactgcagcagtctgggcctgagctggagaagcctggcgcttcagtgaagatatcctgcaaggcttctggttactcattcactggctacaccatgaactgggtgaagcagagccatggaaagagccttgagtggattggacttattactccttacaatggtgcttctagctacaaccagaagttcaggggcaaggccacattaactgtagacaagtcatccagcacagcctacatggacctcctcagtctgacatctgaagactctgcagtctatttctgtgcaagggggggttacgacgggaggggttttgactactggggccaagggaccacggtcaccgtctcctcaggtggaggcggttcaggcggcggtggctctagcggtggtggatcggacatcgagctcactcagtctccagcaatcatgtctgcatctccaggggagaaggtcaccatgacctgcagtgccagctcaagtgtaagttacatgcactggtaccagcagaagtcaggcacctcccccaaaagatggatttatgacacatccaaactggcttctggagtcccaggtcgcttcagtggcagtgggtctggaaactcttactctctcacaatcagcagcgtggaggctgaagatgatgcaacttattactgccagcagtggagtaagcaccctctcacgtacggtgctgggacaaagttggaaatcaaagctagcacgcgtggtggcggaggttctggaggtgggggttcccagggggcctggccacatgagggagtccacagaaaaccttccctcctggcccacccaggtcccctggtgaaatcagaagagacagtcatcctgcaatgttggtcagatgtcaggtttgagcacttccttctgcacagagaggggaagtataaggacactttgcacctcattggagagcaccatgatggggtctccaaggccaacttctccatcggtcccatgatgcaagaccttgcagggacctacagatgctacggttctgttactcactccccctatcagttgtcagctcccagtgaccctctggacatcgtcatcacaggtctatatgagaaaccttctctctcagcccagccgggccccacggttttggcaggagagagcgtgaccttgtcctgcagctcccggagctcctatgacatgtaccatctatccagggagggggaggcccatgaacgtaggttctctgcagggcccaaggtcaacggaacattccaggccgactttcctctgggccctgccacccacggaggaacctacagatgcttcggctctttccgtgactctccctatgagtggtcaaactcgagtgacccactgcttgtttctgtcacaggaaacccttcaaatagttggccttcacccactgaaccaagctccaaaaccggtaaccccagacacctgcatgttctgattgggacctcagtggtcaaaatccctttcaccatcctcctcttctttctccttcatcgctggtgctccaacaaaaaaaatgctgctgtaatggaccaagagcctgcagggaacagaacagtgaacagcgaggattctgatgaacaagaccatcaggaggtgtcatacgcataa

SEQ ID NO: 351 - protein, 565 aa, Artificial Sequence
  source: /note="Description of Artificial Sequence: Synthetic polypeptide"
MALPVTALLLPLALLLHAARPGSQVQLQQSGPELEKPGASVKISCKASGYSFTGYTMNWVKQSHGKSLEWIGLITPYNGASSYNQKFRGKATLTVDKSSSTAYMDLLSLTSEDSAVYFCARGGYDGRGFDYWGQGTTVTVSSGGGGSGGGGSSGGGSDIELTQSPAIMSASPGEKVTMTCSASSSVSYMHWYQQKSGTSPKRWIYDTSKLASGVPGRFSGSGSGNSYSLTISSVEAEDDATYYCQQWSKHPLTYGAGTKLEIKASTRGGGGSGGGGSQGAWPHEGVHRKPSLLAHPGPLVKSEETVILQCWSDVRFEHFLLHREGKYKDTLHLIGEHHDGVSKANFSIGPMMQDLAGTYRCYGSVTHSPYQLSAPSDPLDIVITGLYEKPSLSAQPGPTVLAGESVTLSCSSRSSYDMYHLSREGEAHERRFSAGPKVNGTFQADFPLGPATHGGTYRCFGSFRDSPYEWSNSSDPLLVSVTGNPSNSWPSPTEPSSKTGNPRHLHVLIGTSVVKIPFTILLFFLLHRWCSNKKNAAVMDQEPAGNRTVNSEDSDEQDHQEVSYA

SEQ ID NO: 352 - DNA, 1035 bp, Artificial Sequence
  source: /note="Description of Artificial Sequence: Synthetic polynucleotide"
  CDS (1)..(1032)
atggccttaccagtgaccgccttgctcctgccgctggccttgctgctccacgccgccaggccgggatcccaggtacaactgcagcagtctgggcctgagctggagaagcctggcgcttcagtgaagatatcctgcaaggcttctggttactcattcactggctacaccatgaactgggtgaagcagagccatggaaagagccttgagtggattggacttattactccttacaatggtgcttctagctacaaccagaagttcaggggcaaggccacattaactgtagacaagtcatccagcacagcctacatggacctcctcagtctgacatctgaagactctgcagtctatttctgtgcaagggggggttacgacgggaggggttttgactactggggccaagggaccacggtcaccgtctcctcaggtggaggcggttcaggcggcggtggctctagcggtggtggatcggacatcgagctcactcagtctccagcaatcatgtctgcatctccaggggagaaggtcaccatgacctgcagtgccagctcaagtgtaagttacatgcactggtaccagcagaagtcaggcacctcccccaaaagatggatttatgacacatccaaactggcttctggagtcccaggtcgcttcagtggcagtgggtctggaaactcttactctctcacaatcagcagcgtggaggctgaagatgatgcaacttattactgccagcagtggagtaagcaccctctcacgtacggtgctgggacaaagttggaaatcaaagctagcggtggcggaggttctggaggtgggggttccttaaccacagagacgggactccagaaagaccatgccctctgggatcacactgcccagaatctccttcggatgggcctggcctttctagtcctggtggctctagtgtggttcctggttgaagactggctcagcaggaagaggactagagagcgagccagcagagcttccacttgggaaggcaggagaaggctgaacacacagactctttga

SEQ ID NO: 353 - protein, 344 aa, Artificial Sequence
  source: /note="Description of Artificial Sequence: Synthetic polypeptide"
MALPVTALLLPLALLLHAARPGSQVQLQQSGPELEKPGASVKISCKASGYSFTGYTMNWVKQSHGKSLEWIGLITPYNGASSYNQKFRGKATLTVDKSSSTAYMDLLSLTSEDSAVYFCARGGYDGRGFDYWGQGTTVTVSSGGGGSGGGGSSGGGSDIELTQSPAIMSASPGEKVTMTCSASSSVSYMHWYQQKSGTSPKRWIYDTSKLASGVPGRFSGSGSGNSYSLTISSVEAEDDATYYCQQWSKHPLTYGAGTKLEIKASGGGGSGGGGSLTTETGLQKDHALWDHTAQNLLRMGLAFLVLVALVWFLVEDWLSRKRTRERASRASTWEGRRRLNTQTL

SEQ ID NO: 354 - DNA, 1194 bp, Artificial Sequence
  source: /note="Description of Artificial Sequence: Synthetic polynucleotide"
  CDS (1)..(1191)
atggccttaccagtgaccgccttgctcctgccgctggccttgctgctccacgccgccaggccgggatcccaggtacaactgcagcagtctgggcctgagctggagaagcctggcgcttcagtgaagatatcctgcaaggcttctggttactcattcactggctacaccatgaactgggtgaagcagagccatggaaagagccttgagtggattggacttattactccttacaatggtgcttctagctacaaccagaagttcaggggcaaggccacattaactgtagacaagtcatccagcacagcctacatggacctcctcagtctgacatctgaagactctgcagtctatttctgtgcaagggggggttacgacgggaggggttttgactactggggccaagggaccacggtcaccgtctcctcaggtggaggcggttcaggcggcggtggctctggcggtggcggatcggacatcgagctcactcagtctccagcaatcatgtctgcatctccaggggagaaggtcaccatgacctgcagtgccagctcaagtgtaagttacatgcactggtaccagcagaagtcaggcacctcccccaaaagatggatttatgacacatccaaactggcttctggagtcccaggtcgcttcagtggcagtgggtctggaaactcttactctctcacaatcagcagcgtggaggctgaagatgatgcaacttattactgccagcagtggagtggttaccctctcacgttcggtgctgggacaaagttggaaatcaaaggtggagactacaaggacgacgacgacaaggctagcggtggcggaggttctggaggtgggggttcctcacccactgaaccaagctccgaaaccggtaaccccagacacctgcatgttctgattgggacctcagtggtcatcatcctcttcatcctcctcctcttctttctccttcatcgctggtgctgcaacaaaaaaaatgctgttgtaatggaccaagagcctgcagggaacagaacagtgaacagggaggactctgatgaacaagaccctcaggaggtgacatatgcacagttgaatcactgcgttttcacacagagaaaaatcactcacccttctcagaggcccaagacacccccaacagatatcatcgtgtacacggaacttccaaatgctgagccctga

SEQ ID NO: 355 - protein, 397 aa, Artificial Sequence
  source: /note="Description of Artificial Sequence: Synthetic polypeptide"
MALPVTALLLPLALLLHAARPGSQVQLQQSGPELEKPGASVKISCKASGYSFTGYTMNWVKQSHGKSLEWIGLITPYNGASSYNQKFRGKATLTVDKSSSTAYMDLLSLTSEDSAVYFCARGGYDGRGFDYWGQGTTVTVSSGGGGSGGGGSGGGGSDIELTQSPAIMSASPGEKVTMTCSASSSVSYMHWYQQKSGTSPKRWIYDTSKLASGVPGRFSGSGSGNSYSLTISSVEAEDDATYYCQQWSGYPLTFGAGTKLEIKGGDYKDDDDKASGGGGSGGGGSSPTEPSSETGNPRHLHVLIGTSVVIILFILLLFFLLHRWCCNKKNAVVMDQEPAGNRTVNREDSDEQDPQEVTYAQLNHCVFTQRKITHPSQRPKTPPTDIIVYTELPNAEP

SEQ ID NO: 356 - DNA, 30 bp, Artificial Sequence
  source: /note="Description of Artificial Sequence: Synthetic oligonucleotide"
ggtggcggaggttctggaggtgggggttcc

SEQ ID NO: 357 - protein, 20 aa, Artificial Sequence
  source: /note="Description of Artificial Sequence: Synthetic peptide"
VLIGTSVVKIPFTILLFFLL

SEQ ID NO: 358 - protein, 20 aa, Artificial Sequence
  source: /note="Description of Artificial Sequence: Synthetic peptide"
VLIGTSVVIILFILLLFFLL

SEQ ID NO: 359 - protein, 24 aa, Artificial Sequence
  source: /note="Description of Artificial Sequence: Synthetic peptide"
LLRMGLAFLVLVALVWFLVEDWLS

SEQ ID NO: 360 - protein, 39 aa, Artificial Sequence
  source: /note="Description of Artificial Sequence: Synthetic polypeptide"
HRWCSNKKNAAVMDQEPAGNRTVNSEDSDEQDHQEVSYA

SEQ ID NO: 361 - protein, 76 aa, Artificial Sequence
  source: /note="Description of Artificial Sequence: Synthetic polypeptide"
HRWCCNKKNAVVMDQEPAGNRTVNREDSDEQDPQEVTYAQLNHCVFTQRKITHPSQRPKTPPTDIIVYTELPNAEP

SEQ ID NO: 362 - protein, 25 aa, Artificial Sequence
  source: /note="Description of Artificial Sequence: Synthetic peptide"
RKRTRERASRASTWEGRRRLNTQTL

SEQ ID NO: 363 - DNA, 1056 bp, Artificial Sequence
  source: /note="Description of Artificial Sequence: Synthetic polynucleotide"
atggccttaccagtgaccgccttgctcctgccgctggccttgctgctccacgccgccaggccgggatcccaagtccaactcgttcaatcaggcgcagaagtcgaaaagcccggagcatcagtcaaagtctcttgcaaggcttccggctacaccttcacggactactacatgcactgggtgcgccaggctccaggccagggactggagtggatgggatggatcaacccgaattccgggggaactaactacgcccagaagtttcagggccgggtgactatgactcgcgatacctcgatctcgactgcgtacatggagctcagccgcctccggtcggacgataccgccgtgtactattgtgcgtcgggatgggacttcgactactgggggcagggcactctggtcactgtgtcaagcggaggaggtggatcaggtggaggtggaagcgggggaggaggttccggcggcggaggatcagatatcgtgatgacgcaatcgccttcctcgttgtccgcatccgtgggagacagggtgaccattacttgcagagcgtcccagtccattcggtactacctgtcgtggtaccagcagaagccggggaaagccccaaaactgcttatctatactgcctcgatcctccaaaacggcgtgccatcaagattcagcggttcgggcagcgggaccgactttaccctgactatcagcagcctgcagccggaagatttcgccacgtactactgcctgcaaacctacaccaccccggacttcggacctggaaccaaggtggagatcaaggctagcggtggcggaggttctggaggtgggggttcctcacccactgaaccaagctccaaaaccggtaaccccagacacctgcatgttctgattgggacctcagtggtcaaaatccctttcaccatcctcctcttctttctccttcatcgctggtgctccaacaaaaaaaatgctgctgtaatggaccaagagcctgcagggaacagaacagtgaacagcgaggattctgatgaacaagaccatcaggaggtgtcatacgcataa

SEQ ID NO: 364 - protein, 351 aa, Artificial Sequence
  source: /note="Description of Artificial Sequence: Synthetic polypeptide"
MALPVTALLLPLALLLHAARPGSQVQLVQSGAEVEKPGASVKVSCKASGYTFTDYYMHWVRQAPGQGLEWMGWINPNSGGTNYAQKFQGRVTMTRDTSISTAYMELSRLRSDDTAVYYCASGWDFDYWGQGTLVTVSSGGGGSGGGGSGGGGSGGGGSDIVMTQSPSSLSASVGDRVTITCRASQSIRYYLSWYQQKPGKAPKLLIYTASILQNGVPSRFSGSGSGTDFTLTISSLQPEDFATYYCLQTYTTPDFGPGTKVEIKASGGGGSGGGGSSPTEPSSKTGNPRHLHVLIGTSVVKIPFTILLFFLLHRWCSNKKNAAVMDQEPAGNRTVNSEDSDEQDHQEVSYA

SEQ ID NO: 365 - DNA, 1467 bp, Artificial Sequence
  source: /note="Description of Artificial Sequence: Synthetic polynucleotide"
atggggggacttgaaccctgcagcaggttcctgctcctgcctctcctgctggctgtaagtggtctccgtcctgtccaggtccaggcccagagcgattgcagttgctctacggtgagcccgggcgtgctggcagggatcgtgatgggagacctggtgctgacagtgctcattgccctggccgtgtacttcctgggccggctggtccctcgggggcgaggggctgcggaggcagcgacccggaaacagcgtatcactgagaccgagtcgccttatcaggagctccagggtcagaggtcggatgtctacagcgacctcaacacacagaggccgtattacaaatccggaggcagcggagagggcagaggaagtcttctaacatgcggtgacgtggaggagaatcccggccctaggatggccttaccagtgaccgccttgctcctgccgctggccttgctgctccacgccgccaggccgggatcccaagtccaactcgttcaatcaggcgcagaagtcgaaaagcccggagcatcagtcaaagtctcttgcaaggcttccggctacaccttcacggactactacatgcactgggtgcgccaggctccaggccagggactggagtggatgggatggatcaacccgaattccgggggaactaactacgcccagaagtttcagggccgggtgactatgactcgcgatacctcgatctcgactgcgtacatggagctcagccgcctccggtcggacgataccgccgtgtactattgtgcgtcgggatgggacttcgactactgggggcagggcactctggtcactgtgtcaagcggaggaggtggatcaggtggaggtggaagcgggggaggaggttccggcggcggaggatcagatatcgtgatgacgcaatcgccttcctcgttgtccgcatccgtgggagacagggtgaccattacttgcagagcgtcccagtccattcggtactacctgtcgtggtaccagcagaagccggggaaagccccaaaactgcttatctatactgcctcgatcctccaaaacggcgtgccatcaagattcagcggttcgggcagcgggaccgactttaccctgactatcagcagcctgcagccggaagatttcgccacgtactactgcctgcaaacctacaccaccccggacttcggacctggaaccaaggtggagatcaaggctagcggtggcggaggttctggaggtgggggttcctcacccactgaaccaagctccaaaaccggtaaccccagacacctgcatgttctgattgggacctcagtggtcaaaatccctttcaccatcctcctcttctttctccttcatcgctggtgctccaacaaaaaaaatgctgctgtaatggaccaagagcctgcagggaacagaacagtgaacagcgaggattctgatgaacaagaccatcaggaggtgtcatacgcataa

SEQ ID NO: 366 - protein, 488 aa, Artificial Sequence
  source: /note="Description of Artificial Sequence: Synthetic polypeptide"
MGGLEPCSRFLLLPLLLAVSGLRPVQVQAQSDCSCSTVSPGVLAGIVMGDLVLTVLIALAVYFLGRLVPRGRGAAEAATRKQRITETESPYQELQGQRSDVYSDLNTQRPYYKSGGSGEGRGSLLTCGDVEENPGPRMALPVTALLLPLALLLHAARPGSQVQLVQSGAEVEKPGASVKVSCKASGYTFTDYYMHWVRQAPGQGLEWMGWINPNSGGTNYAQKFQGRVTMTRDTSISTAYMELSRLRSDDTAVYYCASGWDFDYWGQGTLVTVSSGGGGSGGGGSGGGGSGGGGSDIVMTQSPSSLSASVGDRVTITCRASQSIRYYLSWYQQKPGKAPKLLIYTASILQNGVPSRFSGSGSGTDFTLTISSLQPEDFATYYCLQTYTTPDFGPGTKVEIKASGGGGSGGGGSSPTEPSSKTGNPRHLHVLIGTSVVKIPFTILLFFLLHRWCSNKKNAAVMDQEPAGNRTVNSEDSDEQDHQEVSYA

SEQ ID NO: 367 - DNA, 342 bp, Artificial Sequence
  source: /note="Description of Artificial Sequence: Synthetic polynucleotide"
atggggggacttgaaccctgcagcaggttcctgctcctgcctctcctgctggctgtaagtggtctccgtcctgtccaggtccaggcccagagcgattgcagttgctctacggtgagcccgggcgtgctggcagggatcgtgatgggagacctggtgctgacagtgctcattgccctggccgtgtacttcctgggccggctggtccctcgggggcgaggggctgcggaggcagcgacccggaaacagcgtatcactgagaccgagtcgccttatcaggagctccagggtcagaggtcggatgtctacagcgacctcaacacacagaggccgtattacaaatga

SEQ ID NO: 368 - protein, 113 aa, Artificial Sequence
  source: /note="Description of Artificial Sequence: Synthetic polypeptide"
MGGLEPCSRFLLLPLLLAVSGLRPVQVQAQSDCSCSTVSPGVLAGIVMGDLVLTVLIALAVYFLGRLVPRGRGAAEAATRKQRITETESPYQELQGQRSDVYSDLNTQRPYYK

SEQ ID NO: 369 - DNA, 261 bp, Artificial Sequence
  source: /note="Description of Artificial Sequence: Synthetic polynucleotide"
atgattccagcagtggtcttgctcttactccttttggttgaacaagcagcggccctgggagagcctcagctctgctatatcctggatgccatcctgtttctgtatggaattgtcctcaccctcctctactgccgactgaagatccaagtgcgaaaggcagctataaccagctatgagaaatcagatggtgtttacacgggcctgagcaccaggaaccaggagacttacgagactctgaagcatgagaaaccaccacagtag

SEQ ID NO: 370 - protein, 86 aa, Artificial Sequence
  source: /note="Description of Artificial Sequence: Synthetic polypeptide"
MIPAVVLLLLLLVEQAAALGEPQLCYILDAILFLYGIVLTLLYCRLKIQVRKAAITSYEKSDGVYTGLSTRNQETYETLKHEKPPQ

SEQ ID NO: 371 - protein, 59 aa, Artificial Sequence
  source: /note="Description of Artificial Sequence: Synthetic polypeptide"
VLIGTSVVKIPFTILLFFLLHRWCSNKKNAAVMDQEPAGNRTVNSEDSDEQDHQEVSYA

SEQ ID NO: 372 - protein, 12 aa, Artificial Sequence
  source: /note="Description of Artificial Sequence: Synthetic 12xHis tag"
HHHHHHHHHHHH

What is claimed is:

1. An isolated nucleic acid molecule encoding a natural killer cell immune-function receptor-chimeric antigen receptor (NKR-CAR), wherein the encoded NKR-CAR comprises:
   (a) an extracellular antigen binding domain that binds to mesothelin, wherein the antigen binding domain comprises a heavy chain complementarity determining region 1 (HC CDR1), a heavy chain complementarity determining region 2 (HC CDR2), a heavy chain complementarity determining region 3 (HC CDR3), a light chain complementarity determining region 1 (LC CDR1), a light chain complementarity determining region 2 (LC CDR2), and a light chain complementarity determining region 3 (LC CDR3), wherein:
      (i) the HC CDR1, HC CDR2 and HC CDR3 are of the anti-mesothelin heavy chain amino acid sequence in SEQ ID NO: 234, and the LC CDR1, LC CDR2 and LC CDR3 are of the anti-mesothelin light chain amino acid sequence in SEQ ID NO: 234; or
      (ii) the HC CDR1, HC CDR2 and HC CDR3 are of the anti-mesothelin heavy chain amino acid sequence in SEQ ID NO: 240, and the LC CDR1, LC CDR2 and LC CDR3 are of the anti-mesothelin light chain amino acid sequence in SEQ ID NO: 240;
   (b) a NKR transmembrane domain; and
   (c) a cytoplasmic domain.

2. The isolated nucleic acid molecule of claim 1, wherein:
   (a) the antigen binding domain that binds mesothelin comprises:
      a heavy chain variable region comprising:
         i) the amino acid sequence of an anti-mesothelin heavy chain variable region in SEQ ID NO: 234 or 240; or
         ii) an amino acid sequence with at least 95% identity thereto; and/or
      a light chain variable region comprising:
         i) the amino acid sequence of an anti-mesothelin light chain variable region in SEQ ID NO: 234 or 240; or
         ii) an amino acid sequence with at least 95% identity thereto; and/or
   (b) the antigen binding domain that binds mesothelin comprises:
      i) the amino acid sequence of SEQ ID NO: 234 or 240; or
      ii) an amino acid sequence with at least 95% identity thereto.

3. The isolated nucleic acid molecule of claim 1, wherein the encoded NKR-CAR comprises:
   a killer cell immunoglobulin-like receptor chimeric antigen receptor (KIR-CAR), wherein the KIR-CAR comprises one or both of a transmembrane domain from a KIR (a KIR transmembrane domain) or a cytoplasmic domain comprising a functional signaling domain from a KIR (a KIR cytoplasmic domain);
   a natural cytotoxicity receptor chimeric antigen receptor (NCR-CAR), wherein the NCR-CAR comprises one or both of a transmembrane domain from a NCR (a NCR transmembrane domain) or a cytoplasmic domain comprising a functional signaling domain from a NCR (a NCR cytoplasmic domain);
   a signaling lymphocyte activation molecule family chimeric antigen receptor (SLAMF-CAR), wherein the SLAMF-CAR comprises one or both of a transmembrane domain from a SLAMF (a SLAMF transmembrane domain) or a cytoplasmic domain comprising a functional signaling domain from a SLAMF (a SLAMF cytoplasmic domain);
   a Fc receptor chimeric antigen receptor (FcR-CAR), wherein the FcR-CAR comprises one or both of a transmembrane domain from a FcR selected from CD16 or CD64, or a cytoplasmic domain comprising a functional signaling domain from a FcR selected from CD16 or CD64; or
   a Ly49 receptor chimeric antigen receptor (Ly49-CAR), wherein the Ly49-CAR comprises one or both of a transmembrane domain from Ly49 (a Ly49 transmembrane domain) or a cytoplasmic domain comprising a functional signaling domain from Ly49 (a Ly49 cytoplasmic domain).

4. The isolated nucleic acid molecule of claim 3, wherein:
   (i) the KIR transmembrane domain comprises a transmembrane domain of a protein selected from the group consisting of: KIR2DS2, KIR2DL3, KIR2DL1, KIR2DL2, KIR2DL4, KIR2DL5A, KIR2DL5B, KIR2DS1, KIR2DS3, KIR2DS4, KIR2DS5, KIR3DL1, KIR3DS1, KIR3DL2, KIR3DL3, KIR2DP1 and KIR3DP1;

(ii) the KIR cytoplasmic domain comprises a functional signaling domain of a protein selected from the group consisting of: KIR2DS2, KIR2DL3, KIR2DL1, KIR2DL2, KIR2DL4, KIR2DL5A, KIR2DL5B, KIR2DS1, KIR2DS3, KIR2DS4, KIR2DS5, KIR3DL1, KIR3DS1, KIR3DL2, KIR3DL3, KIR2DP1 and KIR3DP1; and/or (iii) the KIR-CAR further comprises one or more of a KIR D0 domain, a KIR D1 domain, and/or a KIR D2 domain.

5. The isolated nucleic acid molecule of claim 3, wherein:
(i) the NCR transmembrane domain comprises a transmembrane domain of a protein selected from the group consisting of: NKp46, NKp30, and NKp44; and/or
(ii) the NCR cytoplasmic domain comprises a functional signaling domain of a protein selected from the group consisting of: NKp46, NKp30, and NKp44.

6. The isolated nucleic acid molecule of claim 3, wherein:
(i) the SLAMF transmembrane domain comprises a transmembrane domain of a protein selected from the group consisting of: SLAM, CD48, CD229, 2B4, CD84, NTB-A, CRACC, BLAME, and CD2F-10; and/or
(ii) the SLAMF cytoplasmic domain comprises a functional signaling domain of a protein selected from the group consisting of: SLAM, CD48, CD229, 2B4, CD84, NTB-A, CRACC, BLAME, and CD2F-10.

7. The isolated nucleic acid molecule of claim 3, wherein:
(i) the Ly49 transmembrane domain comprises a transmembrane domain of a protein selected from the group consisting of: Ly49A, Ly49C, Ly49H, and Ly49D; and/or
(ii) the Ly49 cytoplasmic domain comprises a functional signaling domain of a protein selected from the group consisting of: Ly49A, Ly49C, Ly49H, and Ly49D.

8. The isolated nucleic acid molecule of claim 1, wherein:
(i) the encoded transmembrane domain comprises an NKR transmembrane domain comprising a transmembrane domain of a protein selected from the group consisting of KIR2DS2, KIR2DL3, NKp46, a killer cell immunoglobulin-like receptor (KIR), a natural cytotoxicity receptor (NCR), a signaling lymphocyte activation molecule family (SLAMF), a Fc receptor (FcR), and a Ly49 receptor (Ly49);
(ii) the encoded transmembrane domain comprises the amino acid sequence of SEQ ID NO: 357, 358, or 359; an amino acid sequence comprising at least one modification, but not more than 5 modifications of the amino acid sequence of SEQ ID NO: 357, 358, or 359; or an amino acid sequence with at least 95% sequence identity to SEQ ID NO: 357, 358, or 359; or
(iii) the nucleic acid sequence encoding the transmembrane domain comprises nucleotides 771-830 of SEQ ID NO: 342, nucleotides 773-832 of SEQ ID NO: 344, or nucleotides 803-875 of SEQ ID NO: 346, or a nucleic acid sequence with at least 95% sequence identity thereto.

9. The isolated nucleic acid molecule of claim 1, wherein:
(i) the encoded cytoplasmic domain comprises a NKR cytoplasmic domain comprising one or more functional signaling domains of a protein selected from the group consisting of KIR2DS2, KIR2DL3, NKp46, DAP12, a KIR, a NCR, a SLAMF, a FcR, and a Ly49;
(ii) the encoded cytoplasmic domain comprises the amino acid sequence of SEQ ID NO: 360, 361, or 362; an amino acid sequence comprising at least one modification, but not more than 20 modifications of the amino acid sequence of SEQ ID NO: 360, 361, or 362; or an amino acid sequence with at least 95% sequence identity to SEQ ID NO: 360, 361, or 362; or
(iii) the nucleic acid sequence encoding the cytoplasmic domain comprises nucleotides 831-947 of SEQ ID NO: 342, nucleotides 833-1060 of SEQ ID NO: 344, or nucleotides 876-949 of SEQ ID NO: 346, or a nucleic acid sequence with at least 95% sequence identity thereto.

10. The isolated nucleic acid molecule of claim 1, further comprising a leader sequence.

11. The isolated nucleic acid molecule of claim 1, wherein the extracellular antigen binding domain that binds mesothelin is connected to the transmembrane domain by a hinge domain.

12. The isolated nucleic acid molecule of claim 11, wherein:
(i) the encoded hinge domain is selected from the group consisting of a CD8 hinge, an IgG4 hinge, an IgD hinge, a KIR2DS2 hinge, a KIR hinge, a NCR hinge, a SLAMF hinge, a FcR hinge, and a LY49 hinge; or
(ii) the encoded hinge domain comprises the amino acid sequence of SEQ ID NO: 340, 3, or 4; an amino acid sequence comprising at least one modification, but not more than 5 modifications of the amino acid sequence of SEQ ID NO: 340, 3, or 4; or an amino acid sequence with at least 95% identity to the amino acid sequence of SEQ ID NO: 340, 3, or 4.

13. The isolated nucleic acid molecule of claim 1, wherein:
i) the encoded transmembrane domain and cytoplasmic domain collectively comprise:
the amino acid sequence of amino acids 413-487 of SEQ ID NO: 333 or amino acids 386-454 of SEQ ID NO: 335;
an amino acid sequence having at least one modification, but not more than 30 modifications to amino acids 413-487 of SEQ ID NO: 333 or amino acids 386-454 of SEQ ID NO: 335; or
an amino acid sequence with at least 95% identity to amino acids 413-487 of SEQ ID NO: 333 or amino acids 386-454 of SEQ ID NO: 335; or
ii) the nucleic acid sequence encoding the transmembrane domain and the cytoplasmic domain comprises nucleotides 1237-1464 of SEQ ID NO: 332 or nucleotides 1156-1365 of SEQ ID NO: 334, or a sequence having at least 95% identity thereto.

14. The isolated nucleic acid molecule of claim 1, further comprising a nucleic acid sequence encoding an adaptor molecule.

15. The isolated nucleic acid molecule of claim 14, wherein:
(i) the encoded adaptor molecule comprises a functional signaling domain of DAP12 or Fc epsilon receptor gamma (FcεRγ);
(ii) the encoded adaptor molecule comprises the amino acid sequence of amino acids 1-113 of SEQ ID NO: 333 or amino acids 1-86 of SEQ ID NO: 335; an amino acid sequence having at least one modification, but not more than 20 modifications to amino acids 1-113 of SEQ ID NO: 333 or amino acids 1-86 of SEQ ID NO: 335; or an amino acid sequence with at least 95% identity to amino acids 1-113 of SEQ ID NO: 333 or amino acids 1-86 of SEQ ID NO: 335; or
(iii) the nucleic acid sequence encoding the adaptor molecule comprises nucleotides 1-339 of SEQ ID NO: 332 or nucleotides 1-258 of SEQ ID NO: 334.

16. The isolated nucleic acid molecule of claim 14, further comprising a nucleic acid sequence encoding a peptide cleavage site of T2A, and wherein the nucleic acid encoding the peptide cleavage site links the nucleic acid sequence encoding the NKR-CAR to the nucleic acid sequence encoding the adaptor molecule.

17. The isolated nucleic acid molecule of claim 16, wherein the nucleic acid sequence encoding the peptide cleavage site encodes the amino acid sequence of SEQ ID NO: 57, or an amino acid sequence having at least 95% sequence identity thereto.

18. The isolated nucleic acid molecule of claim 1, further comprising a nucleic acid sequence encoding a T cell based-chimeric antigen receptor (TCAR) or a second NKR-CAR.

19. The isolated nucleic acid molecule of claim 18, wherein the encoded TCAR or the second NKR-CAR comprises an antigen binding domain that binds to a target antigen that is not mesothelin.

20. An isolated NKR-CAR polypeptide encoded by the nucleic acid molecule of claim 1.

21. The isolated NKR-CAR polypeptide of claim 20, wherein:
 (a) the antigen binding domain that binds mesothelin comprises:
  a heavy chain variable region comprising:
   i) the amino acid sequence of an anti-mesothelin heavy chain variable region in SEQ ID NO: 234 or 240; or
   ii) an amino acid sequence with at least 95% identity thereto; and/or
  a light chain variable region comprising:
   i) the amino acid sequence of an anti-mesothelin light chain variable region in SEQ ID NO: 234 or 240; or
   ii) an amino acid sequence with at least 95% identity thereto; and/or
 (b) the antigen binding domain that binds mesothelin comprises:
  i) the amino acid sequence of SEQ ID NO: 234 or 240; or
  ii) an amino acid sequence with at least 95% identity thereto.

22. A isolated NKR-CAR complex, comprising the NKR-CAR polypeptide of claim 20, and an adaptor molecule.

23. The isolated NKR-CAR complex of claim 22, wherein the adaptor molecule comprises:
 (i) a functional signaling domain of DAP12 or FcεRγ;
 (ii) the amino acid sequence of amino acids 1-113 of SEQ ID NO: 333 or amino acids 1-86 of SEQ ID NO: 335;
 (iii) an amino acid sequence having at least one modification, but not more than 20 modifications to amino acids 1-113 of SEQ ID NO: 333 or amino acids 1-86 of SEQ ID NO: 335; or
 (iv) an amino acid sequence with at least 95% identity to amino acids 1-113 of SEQ ID NO: 333 or amino acids 1-86 of SEQ ID NO: 335.

24. A vector comprising the nucleic acid molecule of claim 1, wherein the vector is a DNA vector or an RNA vector.

25. An isolated cell, comprising the nucleic acid molecule of claim 1.

26. A method of making a cell, comprising introducing into the cell the nucleic acid molecule of claim 1.

27. A method of treating a mammal having a disease or disorder comprising administering to the mammal an effective amount of a cell comprising the nucleic acid molecule of claim 1.

28. The method of claim 27, wherein:
 (i) the disease or disorder is associated with the expression of mesothelin; and/or
 (ii) the disease or disorder is selected from the group consisting of mesothelioma, malignant pleural mesothelioma, non-small cell lung cancer, small cell lung cancer, squamous cell lung cancer, large cell lung cancer, pancreatic cancer, pancreatic ductal adenocarcinoma, pancreatic metastasis, ovarian cancer, colorectal cancer and bladder cancer, or any combination thereto.

29. The isolated nucleic acid molecule of claim 1, wherein the encoded NKR-CAR is an activating NKR-CAR.

30. The isolated nucleic acid molecule of claim 1, wherein the encoded NKR-CAR is an inhibiting NKR-CAR.

31. The isolated nucleic acid molecule of claim 1, wherein the cytoplasmic domain is a NKR cytoplasmic domain.

32. The isolated nucleic acid molecule of claim 1, wherein the HC CDR1, HC CDR2 and HC CDR3 are of the anti-mesothelin heavy chain amino acid sequence in SEQ ID NO: 234, and the LC CDR1, LC CDR2 and LC CDR3 are of the anti-mesothelin light chain amino acid sequence in SEQ ID NO: 234.

33. The isolated nucleic acid molecule of claim 1, wherein the HC CDR1, HC CDR2 and HC CDR3 are of the anti-mesothelin heavy chain amino acid sequence in SEQ ID NO: 240, and the LC CDR1, LC CDR2 and LC CDR3 are of the anti-mesothelin light chain amino acid sequence in SEQ ID NO: 240.

* * * * *